(12) United States Patent
Liu et al.

(10) Patent No.: US 11,999,947 B2
(45) Date of Patent: *Jun. 4, 2024

(54) ADENOSINE NUCLEOBASE EDITORS AND USES THEREOF

(71) Applicant: President and Fellows of Harvard College, Cambridge, MA (US)

(72) Inventors: David R. Liu, Cambridge, MA (US); Nicole Gaudelli, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/174,569

(22) Filed: Feb. 24, 2023

(65) Prior Publication Data

US 2024/0076652 A1    Mar. 7, 2024

Related U.S. Application Data

(63) Continuation of application No. 17/148,059, filed on Jan. 13, 2021, now Pat. No. 11,702,651, which is a continuation of application No. 16/143,370, filed on Sep. 26, 2018, now Pat. No. 10,947,530, which is a continuation of application No. 15/791,085, filed on Oct. 23, 2017, now Pat. No. 10,113,163, which is a continuation of application No. PCT/US2017/045381, filed on Aug. 3, 2017.

(60) Provisional application No. 62/473,714, filed on Mar. 20, 2017, provisional application No. 62/454,035, filed on Feb. 2, 2017, provisional application No. 62/370,684, filed on Aug. 3, 2016.

(51) Int. Cl.
    *C12N 15/10* (2006.01)
    *C12N 9/22* (2006.01)
    *C12N 9/78* (2006.01)

(52) U.S. Cl.
    CPC ........... *C12N 15/1024* (2013.01); *C12N 9/22* (2013.01); *C12N 9/78* (2013.01); *C12Y 305/04004* (2013.01)

(58) Field of Classification Search
    CPC ........ C12N 15/1024; C12N 9/22; C12N 9/78; C12Y 305/04004
    See application file for complete search history.

(56) References Cited

U.S. PATENT DOCUMENTS

| | | |
|---|---|---|
| 4,182,449 A | 1/1980 | Kozlow |
| 4,186,183 A | 1/1980 | Steck et al. |
| 4,217,344 A | 8/1980 | Vanlerberghe et al. |
| 4,235,871 A | 11/1980 | Papahadjopoulos et al. |
| 4,261,975 A | 4/1981 | Fullerton et al. |
| 4,485,054 A | 11/1984 | Mezei et al. |
| 4,501,728 A | 2/1985 | Geho et al. |
| 4,663,290 A | 5/1987 | Weis et al. |
| 4,737,323 A | 4/1988 | Martin et al. |
| 4,774,085 A | 9/1988 | Fidler |
| 4,797,368 A | 1/1989 | Carter et al. |
| 4,837,028 A | 6/1989 | Allen |
| 4,873,316 A | 10/1989 | Meade et al. |
| 4,880,635 A | 11/1989 | Janoff et al. |
| 4,889,818 A | 12/1989 | Gelfand et al. |
| 4,897,355 A | 1/1990 | Eppstein et al. |
| 4,906,477 A | 3/1990 | Kurono et al. |
| 4,911,928 A | 3/1990 | Wallach |
| 4,917,951 A | 4/1990 | Wallach |
| 4,920,016 A | 4/1990 | Allen et al. |
| 4,921,757 A | 5/1990 | Wheatley et al. |
| 4,946,787 A | 8/1990 | Eppstein et al. |
| 4,965,185 A | 10/1990 | Grischenko et al. |
| 5,017,492 A | 5/1991 | Kotewicz et al. |
| 5,047,342 A | 9/1991 | Chatterjee |
| 5,049,386 A | 9/1991 | Eppstein et al. |
| 5,079,352 A | 1/1992 | Gelfand et al. |
| 5,139,941 A | 8/1992 | Muzyczka et al. |
| 5,173,414 A | 12/1992 | Lebkowski et al. |
| 5,223,409 A | 6/1993 | Ladner et al. |
| 5,244,797 A | 9/1993 | Kotewicz et al. |
| 5,270,179 A | 12/1993 | Chatterjee |
| 5,374,553 A | 12/1994 | Gelfand et al. |
| 5,405,776 A | 4/1995 | Kotewicz et al. |
| 5,436,149 A | 7/1995 | Barnes |
| 5,449,639 A | 9/1995 | Wei et al. |
| 5,496,714 A | 3/1996 | Comb et al. |
| 5,512,462 A | 4/1996 | Cheng |
| 5,580,737 A | 12/1996 | Polisky et al. |

(Continued)

FOREIGN PATENT DOCUMENTS

| | | |
|---|---|---|
| AU | 2012244264 A1 | 11/2012 |
| AU | 2012354062 A1 | 7/2014 |

(Continued)

OTHER PUBLICATIONS

U.S. Appl. No. 61/716,256, filed Oct. 19, 2012, Jinek et al.

(Continued)

*Primary Examiner* — Paul J Holland
(74) *Attorney, Agent, or Firm* — Wolf, Greenfield & Sacks, P.C.

(57) ABSTRACT

The disclosure provides adenosine deaminases that are capable of deaminating adenosine in DNA. The disclosure also provides fusion proteins comprising a Cas9 (e.g., a Cas9 nickase) domain and adenosine deaminases that deaminate adenosine in DNA. In some embodiments, the fusion proteins further comprise a nuclear localization sequence (NLS), and/or an inhibitor of base repair, such as, a nuclease dead inosine specific nuclease (dISN).

21 Claims, 248 Drawing Sheets

Specification includes a Sequence Listing.

(56) References Cited

U.S. PATENT DOCUMENTS

| | | |
|---|---|---|
| 5,614,365 A | 3/1997 | Tabor et al. |
| 5,652,094 A | 7/1997 | Usman et al. |
| 5,658,727 A | 8/1997 | Barbas et al. |
| 5,668,005 A | 9/1997 | Kotewicz et al. |
| 5,677,152 A | 10/1997 | Birch et al. |
| 5,767,099 A | 6/1998 | Harris et al. |
| 5,780,053 A | 7/1998 | Ashley et al. |
| 5,830,430 A | 11/1998 | Unger et al. |
| 5,834,247 A | 11/1998 | Comb et al. |
| 5,835,699 A | 11/1998 | Kimura |
| 5,844,075 A | 12/1998 | Kawakami et al. |
| 5,849,548 A | 12/1998 | Haseloff et al. |
| 5,851,548 A | 12/1998 | Dattagupta et al. |
| 5,855,910 A | 1/1999 | Ashley et al. |
| 5,856,463 A | 1/1999 | Blankenborg et al. |
| 5,962,313 A | 10/1999 | Podsakoff et al. |
| 5,981,182 A | 11/1999 | Jacobs, Jr. et al. |
| 6,015,794 A | 1/2000 | Haseloff et al. |
| 6,057,153 A | 5/2000 | George et al. |
| 6,063,608 A | 5/2000 | Kotewicz et al. |
| 6,077,705 A | 6/2000 | Duan et al. |
| 6,156,509 A | 12/2000 | Schellenberger |
| 6,183,998 B1 | 2/2001 | Ivanov et al. |
| 6,355,415 B1 | 3/2002 | Wagner et al. |
| 6,429,298 B1 | 8/2002 | Ellington et al. |
| 6,453,242 B1 | 9/2002 | Eisenberg et al. |
| 6,479,264 B1 | 11/2002 | Louwrier |
| 6,503,717 B2 | 1/2003 | Case et al. |
| 6,534,261 B1 | 3/2003 | Cox, III et al. |
| 6,589,768 B1 | 7/2003 | Kotewicz et al. |
| 6,599,692 B1 | 7/2003 | Case et al. |
| 6,607,882 B1 | 8/2003 | Cox, III et al. |
| 6,610,522 B1 | 8/2003 | Kotewicz et al. |
| 6,689,558 B2 | 2/2004 | Case |
| 6,716,973 B2 | 4/2004 | Baskerville et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,045,337 B2 | 5/2006 | Schultz et al. |
| 7,067,650 B1 | 6/2006 | Tanaka |
| 7,070,928 B2 | 7/2006 | Liu et al. |
| 7,078,208 B2 | 7/2006 | Smith et al. |
| 7,083,970 B2 | 8/2006 | Schultz et al. |
| 7,163,824 B2 | 1/2007 | Cox, III et al. |
| 7,192,739 B2 | 3/2007 | Liu et al. |
| 7,223,545 B2 | 5/2007 | Liu et al. |
| 7,354,761 B2 | 4/2008 | Schultz et al. |
| 7,368,275 B2 | 5/2008 | Schultz et al. |
| 7,442,160 B2 | 10/2008 | Liu et al. |
| 7,476,500 B1 | 1/2009 | Liu et al. |
| 7,476,734 B2 | 1/2009 | Liu |
| 7,479,573 B2 | 1/2009 | Chu et al. |
| 7,491,494 B2 | 2/2009 | Liu et al. |
| 7,541,450 B2 | 6/2009 | Liu et al. |
| 7,557,068 B2 | 7/2009 | Liu et al. |
| 7,595,179 B2 | 9/2009 | Chen et al. |
| 7,638,300 B2 | 12/2009 | Schultz et al. |
| 7,670,807 B2 | 3/2010 | Lampson et al. |
| 7,678,554 B2 | 3/2010 | Liu et al. |
| 7,713,721 B2 | 5/2010 | Schultz et al. |
| 7,771,935 B2 | 8/2010 | Liu et al. |
| 7,794,931 B2 | 9/2010 | Breaker et al. |
| 7,807,408 B2 | 10/2010 | Liu et al. |
| 7,851,658 B2 | 12/2010 | Liu et al. |
| 7,915,025 B2 | 3/2011 | Schultz et al. |
| 7,919,277 B2 | 4/2011 | Russell et al. |
| 7,993,672 B2 | 8/2011 | Huang et al. |
| 7,998,904 B2 | 8/2011 | Liu et al. |
| 8,012,739 B2 | 9/2011 | Schultz et al. |
| 8,017,323 B2 | 9/2011 | Liu et al. |
| 8,017,755 B2 | 9/2011 | Liu et al. |
| 8,030,074 B2 | 10/2011 | Schultz et al. |
| 8,067,556 B2 | 11/2011 | Hogrefe et al. |
| 8,114,648 B2 | 2/2012 | Schultz et al. |
| 8,173,364 B2 | 5/2012 | Schultz et al. |
| 8,173,392 B2 | 5/2012 | Schultz et al. |
| 8,183,012 B2 | 5/2012 | Schultz et al. |
| 8,183,178 B2 | 5/2012 | Liu et al. |
| 8,206,914 B2 | 6/2012 | Liu et al. |
| 8,361,725 B2 | 1/2013 | Russell et al. |
| 8,394,604 B2 | 3/2013 | Liu et al. |
| 8,440,431 B2 | 5/2013 | Voytas et al. |
| 8,440,432 B2 | 5/2013 | Voytas et al. |
| 8,450,471 B2 | 5/2013 | Voytas et al. |
| 8,492,082 B2 | 7/2013 | De Franciscis et al. |
| 8,546,553 B2 | 10/2013 | Terns et al. |
| 8,569,256 B2 | 10/2013 | Heyes et al. |
| 8,586,363 B2 | 11/2013 | Voytas et al. |
| 8,680,069 B2 | 3/2014 | de Fougerolles et al. |
| 8,691,729 B2 | 4/2014 | Liu et al. |
| 8,691,750 B2 | 4/2014 | Constien et al. |
| 8,697,359 B1 | 4/2014 | Zhang |
| 8,697,853 B2 | 4/2014 | Voytas et al. |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,795,965 B2 | 8/2014 | Zhang |
| 8,822,663 B2 | 9/2014 | Schrum et al. |
| 8,835,148 B2 | 9/2014 | Janulaitis et al. |
| 8,846,578 B2 | 9/2014 | McCray et al. |
| 8,871,445 B2 | 10/2014 | Cong et al. |
| 8,889,418 B2 | 11/2014 | Zhang et al. |
| 8,900,814 B2 | 12/2014 | Yasukawa et al. |
| 8,945,839 B2 | 2/2015 | Zhang |
| 8,975,232 B2 | 3/2015 | Liu et al. |
| 8,993,233 B2 | 3/2015 | Zhang et al. |
| 8,999,641 B2 | 4/2015 | Zhang et al. |
| 9,023,594 B2 | 5/2015 | Liu et al. |
| 9,023,649 B2 | 5/2015 | Mali et al. |
| 9,034,650 B2 | 5/2015 | Padidam |
| 9,068,179 B1 | 6/2015 | Liu et al. |
| 9,150,626 B2 | 10/2015 | Liu et al. |
| 9,163,271 B2 | 10/2015 | Schultz et al. |
| 9,163,284 B2 | 10/2015 | Liu et al. |
| 9,181,535 B2 | 11/2015 | Liu et al. |
| 9,200,045 B2 | 12/2015 | Liu et al. |
| 9,221,886 B2 | 12/2015 | Liu et al. |
| 9,228,207 B2 | 1/2016 | Liu et al. |
| 9,234,213 B2 | 1/2016 | Wu |
| 9,243,038 B2 | 1/2016 | Liu et al. |
| 9,267,127 B2 | 2/2016 | Liu et al. |
| 9,322,006 B2 | 4/2016 | Liu et al. |
| 9,322,037 B2 | 4/2016 | Liu et al. |
| 9,340,799 B2 | 5/2016 | Liu et al. |
| 9,340,800 B2 | 5/2016 | Liu et al. |
| 9,359,599 B2 | 6/2016 | Liu et al. |
| 9,388,430 B2 | 7/2016 | Liu et al. |
| 9,394,537 B2 | 7/2016 | Liu et al. |
| 9,434,774 B2 | 9/2016 | Liu et al. |
| 9,458,484 B2 | 10/2016 | Ma et al. |
| 9,512,446 B1 | 12/2016 | Joung et al. |
| 9,526,724 B2 | 12/2016 | Oshlack et al. |
| 9,526,784 B2 | 12/2016 | Liu et al. |
| 9,534,210 B2 | 1/2017 | Park et al. |
| 9,580,698 B1 | 2/2017 | Xu et al. |
| 9,610,322 B2 | 4/2017 | Liu et al. |
| 9,637,739 B2 | 5/2017 | Siksnys et al. |
| 9,663,770 B2 | 5/2017 | Rogers et al. |
| 9,737,604 B2 | 8/2017 | Liu et al. |
| 9,738,693 B2 | 8/2017 | Telford et al. |
| 9,753,340 B2 | 9/2017 | Saitou |
| 9,771,574 B2 | 9/2017 | Liu et al. |
| 9,783,791 B2 | 10/2017 | Hogrefe et al. |
| 9,816,093 B1 | 11/2017 | Donohoue et al. |
| 9,840,538 B2 | 12/2017 | Telford et al. |
| 9,840,690 B2 | 12/2017 | Karli et al. |
| 9,840,699 B2 | 12/2017 | Liu et al. |
| 9,840,702 B2 | 12/2017 | Collingwood et al. |

(56) References Cited

U.S. PATENT DOCUMENTS

| | | |
|---|---|---|
| 9,850,521 B2 | 12/2017 | Braman et al. |
| 9,873,907 B2 | 1/2018 | Zeiner et al. |
| 9,879,270 B2 | 1/2018 | Hittinger et al. |
| 9,914,939 B2 | 3/2018 | Church et al. |
| 9,932,567 B1 | 4/2018 | Xu et al. |
| 9,938,288 B1 | 4/2018 | Kishi et al. |
| 9,944,933 B2 | 4/2018 | Storici et al. |
| 9,982,279 B1 | 5/2018 | Gill et al. |
| 9,999,671 B2 | 6/2018 | Liu et al. |
| 10,011,868 B2 | 7/2018 | Liu et al. |
| 10,053,725 B2 | 8/2018 | Liu et al. |
| 10,059,940 B2 | 8/2018 | Zhong |
| 10,077,453 B2 | 9/2018 | Liu et al. |
| 10,113,163 B2 | 10/2018 | Liu et al. |
| 10,150,955 B2 | 12/2018 | Lambowitz et al. |
| 10,167,457 B2 | 1/2019 | Liu et al. |
| 10,179,911 B2 | 1/2019 | Liu et al. |
| 10,189,831 B2 | 1/2019 | Arrington et al. |
| 10,202,593 B2 | 2/2019 | Liu et al. |
| 10,202,658 B2 | 2/2019 | Parkin et al. |
| 10,227,581 B2 | 3/2019 | Liu et al. |
| 10,323,236 B2 | 6/2019 | Liu et al. |
| 10,336,997 B2 | 7/2019 | Liu et al. |
| 10,358,670 B2 | 7/2019 | Janulaitis et al. |
| 10,392,674 B2 | 8/2019 | Liu et al. |
| 10,407,697 B2 | 9/2019 | Doudna et al. |
| 10,465,176 B2 | 11/2019 | Liu et al. |
| 10,508,298 B2 | 12/2019 | Liu et al. |
| 10,597,679 B2 | 3/2020 | Liu et al. |
| 10,612,011 B2 | 4/2020 | Liu et al. |
| 10,682,410 B2 | 6/2020 | Liu et al. |
| 10,704,062 B2 | 7/2020 | Liu et al. |
| 10,745,677 B2 | 8/2020 | Maianti et al. |
| 10,858,639 B2 | 12/2020 | Liu et al. |
| 10,912,833 B2 | 2/2021 | Liu et al. |
| 10,930,367 B2 | 2/2021 | Zhang et al. |
| 10,947,530 B2 | 3/2021 | Liu et al. |
| 10,954,548 B2 | 3/2021 | Liu et al. |
| 11,046,948 B2 | 6/2021 | Liu et al. |
| 11,053,481 B2 | 7/2021 | Liu et al. |
| 11,124,782 B2 | 9/2021 | Liu et al. |
| 11,214,780 B2 | 1/2022 | Liu et al. |
| 11,268,082 B2 | 3/2022 | Liu et al. |
| 11,299,755 B2 | 4/2022 | Liu et al. |
| 11,306,324 B2 | 4/2022 | Liu et al. |
| 11,319,532 B2 | 5/2022 | Liu et al. |
| 11,447,770 B1 | 9/2022 | Liu et al. |
| 11,542,496 B2 | 1/2023 | Liu et al. |
| 11,542,509 B2 | 1/2023 | Maianti et al. |
| 11,560,566 B2 | 1/2023 | Liu et al. |
| 11,578,343 B2 | 2/2023 | Liu et al. |
| 11,643,652 B2 | 5/2023 | Liu et al. |
| 11,661,590 B2 | 5/2023 | Liu et al. |
| 11,702,651 B2 | 7/2023 | Liu et al. |
| 2003/0082575 A1 | 5/2003 | Schultz et al. |
| 2003/0087817 A1 | 5/2003 | Cox et al. |
| 2003/0096337 A1 | 5/2003 | Hillman et al. |
| 2003/0108885 A1 | 6/2003 | Schultz et al. |
| 2003/0119764 A1 | 6/2003 | Loeb et al. |
| 2003/0167533 A1 | 9/2003 | Yadav et al. |
| 2003/0203480 A1 | 10/2003 | Kovesdi et al. |
| 2004/0003420 A1 | 1/2004 | Kuhn et al. |
| 2004/0115184 A1 | 6/2004 | Smith et al. |
| 2004/0197892 A1 | 10/2004 | Moore et al. |
| 2004/0203109 A1 | 10/2004 | Lal et al. |
| 2005/0136429 A1 | 6/2005 | Guarente et al. |
| 2005/0222030 A1 | 10/2005 | Allison |
| 2005/0260626 A1 | 11/2005 | Lorens et al. |
| 2006/0088864 A1 | 4/2006 | Smolke et al. |
| 2006/0104984 A1 | 5/2006 | Littlefield et al. |
| 2006/0246568 A1 | 11/2006 | Honjo et al. |
| 2007/0015238 A1 | 1/2007 | Snyder et al. |
| 2007/0264692 A1 | 11/2007 | Liu et al. |
| 2007/0269817 A1 | 11/2007 | Shapero |
| 2008/0008697 A1 | 1/2008 | Mintier et al. |
| 2008/0051317 A1 | 2/2008 | Church et al. |
| 2008/0124725 A1 | 5/2008 | Barrangou et al. |
| 2008/0182254 A1 | 7/2008 | Hall et al. |
| 2008/0220502 A1 | 9/2008 | Schellenberger et al. |
| 2008/0241917 A1 | 10/2008 | Akita et al. |
| 2008/0268516 A1 | 10/2008 | Perreault et al. |
| 2009/0130718 A1 | 5/2009 | Short |
| 2009/0215878 A1 | 8/2009 | Tan et al. |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2010/0273857 A1 | 10/2010 | Thakker et al. |
| 2010/0305197 A1 | 12/2010 | Che |
| 2010/0316643 A1 | 12/2010 | Eckert et al. |
| 2011/0016540 A1 | 1/2011 | Weinstein et al. |
| 2011/0059160 A1 | 3/2011 | Essner et al. |
| 2011/0059502 A1 | 3/2011 | Chalasani |
| 2011/0104787 A1 | 5/2011 | Church et al. |
| 2011/0177495 A1 | 7/2011 | Liu et al. |
| 2011/0189775 A1 | 8/2011 | Ainley et al. |
| 2011/0189776 A1 | 8/2011 | Terns et al. |
| 2011/0217739 A1 | 9/2011 | Terns et al. |
| 2011/0301073 A1 | 12/2011 | Gregory et al. |
| 2012/0129759 A1 | 5/2012 | Liu et al. |
| 2012/0141523 A1 | 6/2012 | Castado et al. |
| 2012/0244264 A1 | 9/2012 | Karpinsky et al. |
| 2012/0244601 A1 | 9/2012 | Bertozzi et al. |
| 2012/0270273 A1 | 10/2012 | Zhang et al. |
| 2012/0322861 A1 | 12/2012 | Byrne et al. |
| 2013/0022980 A1 | 1/2013 | Nelson et al. |
| 2013/0059931 A1 | 3/2013 | Petersen-Mahrt et al. |
| 2013/0117869 A1 | 5/2013 | Duchateau et al. |
| 2013/0130248 A1 | 5/2013 | Haurwitz et al. |
| 2013/0158245 A1 | 6/2013 | Russell et al. |
| 2013/0165389 A1 | 6/2013 | Schellenberger et al. |
| 2013/0212725 A1 | 8/2013 | Kuhn et al. |
| 2013/0309720 A1 | 11/2013 | Schultz et al. |
| 2013/0344117 A1 | 12/2013 | Mirosevich et al. |
| 2013/0345064 A1 | 12/2013 | Liu et al. |
| 2014/0004280 A1 | 1/2014 | Loomis |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0065711 A1 | 3/2014 | Liu et al. |
| 2014/0068797 A1 | 3/2014 | Doudna et al. |
| 2014/0127752 A1 | 5/2014 | Zhou et al. |
| 2014/0128449 A1 | 5/2014 | Liu et al. |
| 2014/0141094 A1 | 5/2014 | Smyth et al. |
| 2014/0141487 A1 | 5/2014 | Feldman et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0201858 A1 | 7/2014 | Ostertag et al. |
| 2014/0234289 A1 | 8/2014 | Liu et al. |
| 2014/0248702 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273234 A1 | 9/2014 | Zhang et al. |
| 2014/0283156 A1 | 9/2014 | Zador et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0010526 A1 | 1/2015 | Liu et al. |
| 2015/0031089 A1 | 1/2015 | Lindstrom |
| 2015/0031132 A1 | 1/2015 | Church et al. |
| 2015/0031133 A1 | 1/2015 | Church et al. |

(56) References Cited

U.S. PATENT DOCUMENTS

| | | |
|---|---|---|
| 2015/0044191 A1 | 2/2015 | Liu et al. |
| 2015/0044192 A1 | 2/2015 | Liu et al. |
| 2015/0044772 A1 | 2/2015 | Zhao |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0064789 A1 | 3/2015 | Paschon et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0079681 A1 | 3/2015 | Zhang |
| 2015/0098954 A1 | 4/2015 | Hyde et al. |
| 2015/0118216 A1 | 4/2015 | Liu et al. |
| 2015/0128300 A1 | 5/2015 | Warming et al. |
| 2015/0132269 A1 | 5/2015 | Orkin et al. |
| 2015/0140664 A1 | 5/2015 | Byrne et al. |
| 2015/0159172 A1 | 6/2015 | Miller et al. |
| 2015/0165054 A1 | 6/2015 | Liu et al. |
| 2015/0166980 A1 | 6/2015 | Liu et al. |
| 2015/0166981 A1 | 6/2015 | Liu et al. |
| 2015/0166982 A1 | 6/2015 | Liu et al. |
| 2015/0166983 A1 | 6/2015 | Liu et al. |
| 2015/0166984 A1 | 6/2015 | Liu et al. |
| 2015/0166985 A1 | 6/2015 | Liu et al. |
| 2015/0191744 A1 | 7/2015 | Wolfe et al. |
| 2015/0197759 A1 | 7/2015 | Xu et al. |
| 2015/0211058 A1 | 7/2015 | Carstens |
| 2015/0218573 A1 | 8/2015 | Loque et al. |
| 2015/0225773 A1 | 8/2015 | Farmer et al. |
| 2015/0252358 A1 | 9/2015 | Maeder et al. |
| 2015/0275202 A1 | 10/2015 | Liu et al. |
| 2015/0291965 A1 | 10/2015 | Zhang et al. |
| 2015/0307889 A1 | 10/2015 | Petolino et al. |
| 2015/0315252 A1 | 11/2015 | Haugwitz et al. |
| 2015/0344549 A1 | 12/2015 | Muir et al. |
| 2016/0015682 A2 | 1/2016 | Cawthorne et al. |
| 2016/0017393 A1 | 1/2016 | Jacobson et al. |
| 2016/0017396 A1 | 1/2016 | Cann et al. |
| 2016/0032292 A1 | 2/2016 | Storici et al. |
| 2016/0032353 A1 | 2/2016 | Braman et al. |
| 2016/0040155 A1 | 2/2016 | Maizels et al. |
| 2016/0046952 A1 | 2/2016 | Hittinger et al. |
| 2016/0046961 A1 | 2/2016 | Jinek et al. |
| 2016/0046962 A1 | 2/2016 | May et al. |
| 2016/0053272 A1 | 2/2016 | Wurtzel et al. |
| 2016/0053304 A1 | 2/2016 | Wurtzel et al. |
| 2016/0074535 A1 | 3/2016 | Ranganathan et al. |
| 2016/0076093 A1 | 3/2016 | Shendure et al. |
| 2016/0090603 A1 | 3/2016 | Carnes et al. |
| 2016/0090622 A1 | 3/2016 | Liu et al. |
| 2016/0115488 A1 | 4/2016 | Zhang et al. |
| 2016/0138046 A1 | 5/2016 | Wu |
| 2016/0153003 A1 | 6/2016 | Joung et al. |
| 2016/0186214 A1 | 6/2016 | Brouns et al. |
| 2016/0200779 A1 | 7/2016 | Liu et al. |
| 2016/0201040 A1 | 7/2016 | Liu et al. |
| 2016/0201089 A1 | 7/2016 | Gersbach et al. |
| 2016/0206566 A1 | 7/2016 | Lu et al. |
| 2016/0208243 A1 | 7/2016 | Zhang et al. |
| 2016/0208288 A1 | 7/2016 | Liu et al. |
| 2016/0215275 A1 | 7/2016 | Zhong |
| 2016/0215276 A1 | 7/2016 | Liu et al. |
| 2016/0215300 A1 | 7/2016 | May et al. |
| 2016/0244784 A1 | 8/2016 | Jacobson et al. |
| 2016/0244829 A1 | 8/2016 | Bang et al. |
| 2016/0264934 A1 | 9/2016 | Giallourakis et al. |
| 2016/0272593 A1 | 9/2016 | Ritter et al. |
| 2016/0272965 A1 | 9/2016 | Zhang et al. |
| 2016/0281072 A1 | 9/2016 | Zhang |
| 2016/0298136 A1 | 10/2016 | Chen et al. |
| 2016/0304846 A1 | 10/2016 | Liu et al. |
| 2016/0304855 A1 | 10/2016 | Stark et al. |
| 2016/0312304 A1 | 10/2016 | Sorrentino et al. |
| 2016/0319262 A1 | 11/2016 | Doudna et al. |
| 2016/0333389 A1 | 11/2016 | Liu et al. |
| 2016/0340622 A1 | 11/2016 | Abdou |
| 2016/0340662 A1 | 11/2016 | Zhang et al. |
| 2016/0345578 A1 | 12/2016 | Barrangou et al. |
| 2016/0346360 A1 | 12/2016 | Quake et al. |
| 2016/0346361 A1 | 12/2016 | Quake et al. |
| 2016/0346362 A1 | 12/2016 | Quake et al. |
| 2016/0348074 A1 | 12/2016 | Quake et al. |
| 2016/0348096 A1 | 12/2016 | Liu et al. |
| 2016/0350476 A1 | 12/2016 | Quake et al. |
| 2016/0355796 A1 | 12/2016 | Davidson et al. |
| 2016/0369262 A1 | 12/2016 | Reik et al. |
| 2017/0009224 A1 | 1/2017 | Liu et al. |
| 2017/0009242 A1 | 1/2017 | McKinley et al. |
| 2017/0014449 A1 | 1/2017 | Bangera et al. |
| 2017/0020922 A1 | 1/2017 | Wagner et al. |
| 2017/0037432 A1 | 2/2017 | Donohoue et al. |
| 2017/0044520 A1 | 2/2017 | Liu et al. |
| 2017/0044592 A1 | 2/2017 | Peter et al. |
| 2017/0053729 A1 | 2/2017 | Kotani et al. |
| 2017/0058271 A1 | 3/2017 | Joung et al. |
| 2017/0058272 A1 | 3/2017 | Carter et al. |
| 2017/0058298 A1 | 3/2017 | Kennedy et al. |
| 2017/0073663 A1 | 3/2017 | Wang et al. |
| 2017/0073670 A1 | 3/2017 | Nishida et al. |
| 2017/0087224 A1 | 3/2017 | Quake |
| 2017/0087225 A1 | 3/2017 | Quake |
| 2017/0088587 A1 | 3/2017 | Quake |
| 2017/0088828 A1 | 3/2017 | Quake |
| 2017/0107536 A1 | 4/2017 | Zhang et al. |
| 2017/0107560 A1 | 4/2017 | Peter et al. |
| 2017/0114367 A1 | 4/2017 | Hu et al. |
| 2017/0121693 A1 | 5/2017 | Liu et al. |
| 2017/0145394 A1 | 5/2017 | Yeo et al. |
| 2017/0145405 A1 | 5/2017 | Tang et al. |
| 2017/0145438 A1 | 5/2017 | Kantor |
| 2017/0152528 A1 | 6/2017 | Zhang |
| 2017/0152787 A1 | 6/2017 | Kubo et al. |
| 2017/0159033 A1 | 6/2017 | Kamtekar et al. |
| 2017/0166928 A1 | 6/2017 | Vyas et al. |
| 2017/0175104 A1 | 6/2017 | Doudna et al. |
| 2017/0175142 A1 | 6/2017 | Zhang et al. |
| 2017/0191047 A1 | 7/2017 | Terns et al. |
| 2017/0191078 A1 | 7/2017 | Zhang et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211061 A1 | 7/2017 | Weiss et al. |
| 2017/0226522 A1 | 8/2017 | Hu et al. |
| 2017/0233703 A1 | 8/2017 | Xie et al. |
| 2017/0233708 A1 | 8/2017 | Liu et al. |
| 2017/0233756 A1 | 8/2017 | Begemann et al. |
| 2017/0247671 A1 | 8/2017 | Yung et al. |
| 2017/0247703 A1 | 8/2017 | Sloan et al. |
| 2017/0268022 A1 | 9/2017 | Liu et al. |
| 2017/0275648 A1 | 9/2017 | Barrangou et al. |
| 2017/0275665 A1 | 9/2017 | Silas et al. |
| 2017/0283797 A1 | 10/2017 | Robb et al. |
| 2017/0283831 A1 | 10/2017 | Zhang et al. |
| 2017/0306306 A1 | 10/2017 | Potter et al. |
| 2017/0314016 A1 | 11/2017 | Kim et al. |
| 2017/0362635 A1 | 12/2017 | Chamberlain et al. |
| 2018/0023062 A1 | 1/2018 | Lamb et al. |
| 2018/0064077 A1 | 3/2018 | Dunham et al. |
| 2018/0066258 A1 | 3/2018 | Powell |
| 2018/0068062 A1 | 3/2018 | Zhang et al. |
| 2018/0073012 A1 | 3/2018 | Liu et al. |
| 2018/0080051 A1 | 3/2018 | Sheikh et al. |
| 2018/0087046 A1 | 3/2018 | Badran et al. |
| 2018/0100147 A1 | 4/2018 | Yates et al. |
| 2018/0105867 A1 | 4/2018 | Xiao et al. |
| 2018/0119118 A1 | 5/2018 | Lu et al. |
| 2018/0127759 A1 | 5/2018 | Lu et al. |
| 2018/0127780 A1 | 5/2018 | Liu et al. |

(56) References Cited

U.S. PATENT DOCUMENTS

| | | |
|---|---|---|
| 2018/0155708 A1 | 6/2018 | Church et al. |
| 2018/0155720 A1 | 6/2018 | Donohoue et al. |
| 2018/0163213 A1 | 6/2018 | Aneja et al. |
| 2018/0170984 A1 | 6/2018 | Harris et al. |
| 2018/0179503 A1 | 6/2018 | Maianti et al. |
| 2018/0179547 A1 | 6/2018 | Zhang et al. |
| 2018/0201921 A1 | 7/2018 | Malcolm |
| 2018/0230464 A1 | 8/2018 | Zhong |
| 2018/0230471 A1 | 8/2018 | Storici et al. |
| 2018/0236081 A1 | 8/2018 | Liu et al. |
| 2018/0237758 A1 | 8/2018 | Liu et al. |
| 2018/0237787 A1 | 8/2018 | Maianti et al. |
| 2018/0245066 A1 | 8/2018 | Yao et al. |
| 2018/0245075 A1 | 8/2018 | Khalil et al. |
| 2018/0258418 A1 | 9/2018 | Kim |
| 2018/0265864 A1 | 9/2018 | Li et al. |
| 2018/0273939 A1 | 9/2018 | Yu et al. |
| 2018/0282722 A1 | 10/2018 | Jakimo et al. |
| 2018/0298391 A1 | 10/2018 | Jakimo et al. |
| 2018/0305688 A1 | 10/2018 | Zhong |
| 2018/0305704 A1 | 10/2018 | Zhang |
| 2018/0312822 A1 | 11/2018 | Lee et al. |
| 2018/0312825 A1 | 11/2018 | Liu et al. |
| 2018/0312828 A1 | 11/2018 | Liu et al. |
| 2018/0312835 A1 | 11/2018 | Yao et al. |
| 2018/0327756 A1 | 11/2018 | Zhang et al. |
| 2018/0346927 A1 | 12/2018 | Doudna et al. |
| 2018/0371497 A1 | 12/2018 | Gill et al. |
| 2019/0010481 A1 | 1/2019 | Joung et al. |
| 2019/0055543 A1 | 2/2019 | Tran et al. |
| 2019/0055549 A1 | 2/2019 | Capurso et al. |
| 2019/0062734 A1 | 2/2019 | Cotta-Ramusino et al. |
| 2019/0093099 A1 | 3/2019 | Liu et al. |
| 2019/0185883 A1 | 6/2019 | Liu et al. |
| 2019/0218547 A1 | 7/2019 | Lee et al. |
| 2019/0225955 A1 | 7/2019 | Liu et al. |
| 2019/0233847 A1 | 8/2019 | Savage et al. |
| 2019/0241633 A1 | 8/2019 | Fotin-Mleczek et al. |
| 2019/0256842 A1 | 8/2019 | Liu et al. |
| 2019/0264202 A1 | 8/2019 | Church et al. |
| 2019/0276816 A1 | 9/2019 | Liu et al. |
| 2019/0322992 A1 | 10/2019 | Liu et al. |
| 2019/0352632 A1 | 11/2019 | Liu et al. |
| 2019/0367891 A1 | 12/2019 | Liu et al. |
| 2020/0010818 A1 | 1/2020 | Liu et al. |
| 2020/0010835 A1 | 1/2020 | Maianti et al. |
| 2020/0063127 A1 | 2/2020 | Lu et al. |
| 2020/0071722 A1 | 3/2020 | Liu et al. |
| 2020/0109398 A1 | 4/2020 | Rubens et al. |
| 2020/0172931 A1 | 6/2020 | Liu et al. |
| 2020/0181619 A1 | 6/2020 | Tang et al. |
| 2020/0190493 A1 | 6/2020 | Liu et al. |
| 2020/0216833 A1 | 7/2020 | Liu et al. |
| 2020/0255868 A1 | 8/2020 | Liu et al. |
| 2020/0277587 A1 | 9/2020 | Liu et al. |
| 2020/0323984 A1 | 10/2020 | Liu et al. |
| 2020/0399619 A1 | 12/2020 | Maianti et al. |
| 2020/0399626 A1 | 12/2020 | Liu et al. |
| 2021/0054416 A1 | 2/2021 | Liu et al. |
| 2021/0115428 A1 | 4/2021 | Maianti et al. |
| 2021/0196809 A1 | 7/2021 | Maianti et al. |
| 2021/0198330 A1 | 7/2021 | Liu et al. |
| 2021/0214698 A1 | 7/2021 | Liu et al. |
| 2021/0230577 A1 | 7/2021 | Liu et al. |
| 2021/0254127 A1 | 8/2021 | Liu et al. |
| 2021/0315994 A1 | 10/2021 | Liu et al. |
| 2021/0317440 A1 | 10/2021 | Liu et al. |
| 2022/0033785 A1 | 2/2022 | Liu et al. |
| 2022/0119785 A1 | 4/2022 | Liu et al. |
| 2022/0170013 A1 | 6/2022 | Liu et al. |
| 2022/0177877 A1 | 6/2022 | Church et al. |
| 2022/0204975 A1 | 6/2022 | Liu et al. |
| 2022/0213507 A1 | 7/2022 | Liu et al. |
| 2022/0220462 A1 | 7/2022 | Liu et al. |
| 2022/0238182 A1 | 7/2022 | Shen et al. |
| 2022/0249697 A1 | 8/2022 | Liu et al. |
| 2022/0282275 A1 | 9/2022 | Liu et al. |
| 2022/0290115 A1 | 9/2022 | Liu et al. |
| 2022/0307001 A1 | 9/2022 | Liu et al. |
| 2022/0307003 A1 | 9/2022 | Liu et al. |
| 2022/0315906 A1 | 10/2022 | Liu et al. |
| 2022/0356469 A1 | 11/2022 | Liu et al. |
| 2022/0380740 A1 | 12/2022 | Liu et al. |
| 2022/0389395 A1 | 12/2022 | Liu et al. |
| 2023/0002745 A1 | 1/2023 | Liu et al. |
| 2023/0021641 A1 | 1/2023 | Liu et al. |
| 2023/0056852 A1 | 2/2023 | Liu et al. |
| 2023/0058176 A1 | 2/2023 | Liu et al. |
| 2023/0078265 A1 | 3/2023 | Liu et al. |
| 2023/0086199 A1 | 3/2023 | Liu et al. |
| 2023/0090221 A1 | 3/2023 | Liu et al. |
| 2023/0108687 A1 | 4/2023 | Liu et al. |
| 2023/0123669 A1 | 4/2023 | Liu et al. |
| 2023/0127008 A1 | 4/2023 | Liu et al. |
| 2023/0159913 A1 | 5/2023 | Liu et al. |
| 2023/0193295 A1 | 6/2023 | Maianti et al. |
| 2023/0220374 A1 | 7/2023 | Liu et al. |
| 2023/0272425 A1 | 8/2023 | Liu et al. |
| 2023/0279443 A1 | 9/2023 | Liu et al. |

FOREIGN PATENT DOCUMENTS

| | | |
|---|---|---|
| AU | 2015252023 A1 | 11/2015 |
| AU | 2015101792 A4 | 1/2016 |
| AU | 2012354062 B2 | 9/2017 |
| BR | 112015013786 A2 | 7/2017 |
| CA | 2894668 A1 | 6/2014 |
| CA | 2894681 A1 | 6/2014 |
| CA | 2894684 A1 | 6/2014 |
| CA | 2852593 A1 | 11/2015 |
| CN | 1069962 A | 3/1993 |
| CN | 101460619 A | 6/2009 |
| CN | 101873862 A | 10/2010 |
| CN | 102892777 A | 1/2013 |
| CN | 103224947 A | 7/2013 |
| CN | 103233028 A | 8/2013 |
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 103088008 A | 8/2014 |
| CN | 103981211 A | 8/2014 |
| CN | 103981212 A | 8/2014 |
| CN | 104004778 A | 8/2014 |
| CN | 104004782 A | 8/2014 |
| CN | 104017821 A | 9/2014 |
| CN | 104109687 A | 10/2014 |
| CN | 104178461 A | 12/2014 |
| CN | 104342457 A | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104561095 A | 4/2015 |
| CN | 104593418 A | 5/2015 |
| CN | 104593422 A | 5/2015 |
| CN | 104611370 A | 5/2015 |
| CN | 104651392 A | 5/2015 |
| CN | 104651398 A | 5/2015 |
| CN | 104651399 A | 5/2015 |
| CN | 104651401 A | 5/2015 |
| CN | 104673816 A | 6/2015 |
| CN | 104725626 A | 6/2015 |
| CN | 104726449 A | 6/2015 |
| CN | 104726494 A | 6/2015 |
| CN | 104745626 A | 7/2015 |

(56) References Cited

FOREIGN PATENT DOCUMENTS

| | | | |
|---|---|---|---|
| CN | 104762321 A | 7/2015 |
| CN | 104805078 A | 7/2015 |
| CN | 104805099 A | 7/2015 |
| CN | 104805118 A | 7/2015 |
| CN | 104846010 A | 8/2015 |
| CN | 104894068 A | 9/2015 |
| CN | 104894075 A | 9/2015 |
| CN | 104928321 A | 9/2015 |
| CN | 105039339 A | 11/2015 |
| CN | 105039399 A | 11/2015 |
| CN | 105063061 A | 11/2015 |
| CN | 105087620 A | 11/2015 |
| CN | 105112422 A | 12/2015 |
| CN | 105112445 A | 12/2015 |
| CN | 105112519 A | 12/2015 |
| CN | 105121648 A | 12/2015 |
| CN | 105132427 A | 12/2015 |
| CN | 105132451 A | 12/2015 |
| CN | 105177038 A | 12/2015 |
| CN | 105177126 A | 12/2015 |
| CN | 105210981 A | 1/2016 |
| CN | 105219799 A | 1/2016 |
| CN | 105238806 A | 1/2016 |
| CN | 105255937 A | 1/2016 |
| CN | 105274144 A | 1/2016 |
| CN | 105296518 A | 2/2016 |
| CN | 105296537 A | 2/2016 |
| CN | 105316324 A | 2/2016 |
| CN | 105316327 A | 2/2016 |
| CN | 105316337 A | 2/2016 |
| CN | 105331607 A | 2/2016 |
| CN | 105331608 A | 2/2016 |
| CN | 105331609 A | 2/2016 |
| CN | 105331627 A | 2/2016 |
| CN | 105400773 A | 3/2016 |
| CN | 105400779 A | 3/2016 |
| CN | 105400810 A | 3/2016 |
| CN | 105441451 A | 3/2016 |
| CN | 105462968 A | 4/2016 |
| CN | 105463003 A | 4/2016 |
| CN | 105463027 A | 4/2016 |
| CN | 105492608 A | 4/2016 |
| CN | 105492609 A | 4/2016 |
| CN | 105505976 A | 4/2016 |
| CN | 105505979 A | 4/2016 |
| CN | 105518134 A | 4/2016 |
| CN | 105518135 A | 4/2016 |
| CN | 105518137 A | 4/2016 |
| CN | 105518138 A | 4/2016 |
| CN | 105518139 A | 4/2016 |
| CN | 105518140 A | 4/2016 |
| CN | 105543228 A | 5/2016 |
| CN | 105543266 A | 5/2016 |
| CN | 105543270 A | 5/2016 |
| CN | 105567688 A | 5/2016 |
| CN | 105567689 A | 5/2016 |
| CN | 105567734 A | 5/2016 |
| CN | 105567735 A | 5/2016 |
| CN | 105567738 A | 5/2016 |
| CN | 105593367 A | 5/2016 |
| CN | 105594664 A | 5/2016 |
| CN | 105602987 A | 5/2016 |
| CN | 105624146 A | 6/2016 |
| CN | 105624187 A | 6/2016 |
| CN | 105646719 A | 6/2016 |
| CN | 105647922 A | 6/2016 |
| CN | 105647962 A | 6/2016 |
| CN | 105647968 A | 6/2016 |
| CN | 105647969 A | 6/2016 |
| CN | 105671070 A | 6/2016 |
| CN | 105671083 A | 6/2016 |
| CN | 105695485 A | 6/2016 |
| CN | 105779448 A | 7/2016 |
| CN | 105779449 A | 7/2016 |
| CN | 105802980 A | 7/2016 |
| CN | 105821039 A | 8/2016 |
| CN | 105821040 A | 8/2016 |
| CN | 105821049 A | 8/2016 |
| CN | 105821072 A | 8/2016 |
| CN | 105821075 A | 8/2016 |
| CN | 105821116 A | 8/2016 |
| CN | 105838733 A | 8/2016 |
| CN | 105861547 A | 8/2016 |
| CN | 105861552 A | 8/2016 |
| CN | 105861554 A | 8/2016 |
| CN | 105886498 A | 8/2016 |
| CN | 105886534 A | 8/2016 |
| CN | 105886616 A | 8/2016 |
| CN | 105907758 A | 8/2016 |
| CN | 105907785 A | 8/2016 |
| CN | 105925608 A | 9/2016 |
| CN | 105934516 A | 9/2016 |
| CN | 105950560 A | 9/2016 |
| CN | 105950626 A | 9/2016 |
| CN | 105950633 A | 9/2016 |
| CN | 105950639 A | 9/2016 |
| CN | 105985985 A | 10/2016 |
| CN | 106011104 A | 10/2016 |
| CN | 106011150 A | 10/2016 |
| CN | 106011167 A | 10/2016 |
| CN | 106011171 A | 10/2016 |
| CN | 106032540 A | 10/2016 |
| CN | 106047803 A | 10/2016 |
| CN | 106047877 A | 10/2016 |
| CN | 106047930 A | 10/2016 |
| CN | 106086008 A | 11/2016 |
| CN | 106086028 A | 11/2016 |
| CN | 106086061 A | 11/2016 |
| CN | 106086062 A | 11/2016 |
| CN | 106109417 A | 11/2016 |
| CN | 106119275 A | 11/2016 |
| CN | 106119283 A | 11/2016 |
| CN | 106148286 A | 11/2016 |
| CN | 106148370 A | 11/2016 |
| CN | 106148416 A | 11/2016 |
| CN | 106167525 A | 11/2016 |
| CN | 106167808 A | 11/2016 |
| CN | 106167810 A | 11/2016 |
| CN | 106167821 A | 11/2016 |
| CN | 106172238 A | 12/2016 |
| CN | 106190903 A | 12/2016 |
| CN | 106191057 A | 12/2016 |
| CN | 106191061 A | 12/2016 |
| CN | 106191062 A | 12/2016 |
| CN | 106191064 A | 12/2016 |
| CN | 106191071 A | 12/2016 |
| CN | 106191099 A | 12/2016 |
| CN | 106191107 A | 12/2016 |
| CN | 106191113 A | 12/2016 |
| CN | 106191114 A | 12/2016 |
| CN | 106191116 A | 12/2016 |
| CN | 106191124 A | 12/2016 |
| CN | 106222177 A | 12/2016 |
| CN | 106222193 A | 12/2016 |
| CN | 106222203 A | 12/2016 |
| CN | 106244555 A | 12/2016 |
| CN | 106244557 A | 12/2016 |
| CN | 106244591 A | 12/2016 |
| CN | 106244609 A | 12/2016 |
| CN | 106282241 A | 1/2017 |
| CN | 106318934 A | 1/2017 |
| CN | 106318973 A | 1/2017 |
| CN | 106350540 A | 1/2017 |
| CN | 106367435 A | 2/2017 |
| CN | 106399306 A | 2/2017 |
| CN | 106399311 A | 2/2017 |
| CN | 106399360 A | 2/2017 |
| CN | 106399367 A | 2/2017 |
| CN | 106399375 A | 2/2017 |
| CN | 106399377 A | 2/2017 |
| CN | 106434651 A | 2/2017 |
| CN | 106434663 A | 2/2017 |
| CN | 106434688 A | 2/2017 |
| CN | 106434737 A | 2/2017 |

(56) References Cited

FOREIGN PATENT DOCUMENTS

| | | |
|---|---|---|
| CN | 106434748 A | 2/2017 |
| CN | 106434752 A | 2/2017 |
| CN | 106434782 A | 2/2017 |
| CN | 106446600 A | 2/2017 |
| CN | 106479985 A | 3/2017 |
| CN | 106480027 A | 3/2017 |
| CN | 106480036 A | 3/2017 |
| CN | 106480067 A | 3/2017 |
| CN | 106480080 A | 3/2017 |
| CN | 106480083 A | 3/2017 |
| CN | 106480097 A | 3/2017 |
| CN | 106544351 A | 3/2017 |
| CN | 106544353 A | 3/2017 |
| CN | 106544357 A | 3/2017 |
| CN | 106554969 A | 4/2017 |
| CN | 106566838 A | 4/2017 |
| CN | 106701763 A | 5/2017 |
| CN | 106701808 A | 5/2017 |
| CN | 106701818 A | 5/2017 |
| CN | 106701823 A | 5/2017 |
| CN | 106701830 A | 5/2017 |
| CN | 106754912 A | 5/2017 |
| CN | 106755026 A | 5/2017 |
| CN | 106755077 A | 5/2017 |
| CN | 106755088 A | 5/2017 |
| CN | 106755091 A | 5/2017 |
| CN | 106755097 A | 5/2017 |
| CN | 106755424 A | 5/2017 |
| CN | 106801056 A | 6/2017 |
| CN | 106834323 A | 6/2017 |
| CN | 106834341 A | 6/2017 |
| CN | 106834347 A | 6/2017 |
| CN | 106845151 A | 6/2017 |
| CN | 106868008 A | 6/2017 |
| CN | 106868031 A | 6/2017 |
| CN | 106906240 A | 6/2017 |
| CN | 106906242 A | 6/2017 |
| CN | 106916820 A | 7/2017 |
| CN | 106916852 A | 7/2017 |
| CN | 106939303 A | 7/2017 |
| CN | 106947750 A | 7/2017 |
| CN | 106947780 A | 7/2017 |
| CN | 106957830 A | 7/2017 |
| CN | 106957831 A | 7/2017 |
| CN | 106957844 A | 7/2017 |
| CN | 106957855 A | 7/2017 |
| CN | 106957858 A | 7/2017 |
| CN | 106967697 A | 7/2017 |
| CN | 106967726 A | 7/2017 |
| CN | 106978428 A | 7/2017 |
| CN | 106987570 A | 7/2017 |
| CN | 106987757 A | 7/2017 |
| CN | 107012164 A | 8/2017 |
| CN | 107012174 A | 8/2017 |
| CN | 107012213 A | 8/2017 |
| CN | 107012250 A | 8/2017 |
| CN | 107022562 A | 8/2017 |
| CN | 107034188 A | 8/2017 |
| CN | 107034218 A | 8/2017 |
| CN | 107034229 A | 8/2017 |
| CN | 107043775 A | 8/2017 |
| CN | 107043779 A | 8/2017 |
| CN | 107043787 A | 8/2017 |
| CN | 107058320 A | 8/2017 |
| CN | 107058328 A | 8/2017 |
| CN | 107058358 A | 8/2017 |
| CN | 107058372 A | 8/2017 |
| CN | 107083392 A | 8/2017 |
| CN | 107099533 A | 8/2017 |
| CN | 107099850 A | 8/2017 |
| CN | 107119053 A | 9/2017 |
| CN | 107119071 A | 9/2017 |
| CN | 107129999 A | 9/2017 |
| CN | 107130000 A | 9/2017 |
| CN | 107142272 A | 9/2017 |
| CN | 107142282 A | 9/2017 |
| CN | 107177591 A | 9/2017 |
| CN | 107177595 A | 9/2017 |
| CN | 107177625 A | 9/2017 |
| CN | 107177631 A | 9/2017 |
| CN | 107190006 A | 9/2017 |
| CN | 107190008 A | 9/2017 |
| CN | 107217042 A | 9/2017 |
| CN | 107217075 A | 9/2017 |
| CN | 107227307 A | 10/2017 |
| CN | 107227352 A | 10/2017 |
| CN | 107236737 A | 10/2017 |
| CN | 107236739 A | 10/2017 |
| CN | 107236741 A | 10/2017 |
| CN | 107245502 A | 10/2017 |
| CN | 107254485 A | 10/2017 |
| CN | 107266541 A | 10/2017 |
| CN | 107267515 A | 10/2017 |
| CN | 107287245 A | 10/2017 |
| CN | 107298701 A | 10/2017 |
| CN | 107299114 A | 10/2017 |
| CN | 107304435 A | 10/2017 |
| CN | 107312785 A | 11/2017 |
| CN | 107312793 A | 11/2017 |
| CN | 107312795 A | 11/2017 |
| CN | 107312798 A | 11/2017 |
| CN | 107326042 A | 11/2017 |
| CN | 107326046 A | 11/2017 |
| CN | 107354156 A | 11/2017 |
| CN | 107354173 A | 11/2017 |
| CN | 107356793 A | 11/2017 |
| CN | 107362372 A | 11/2017 |
| CN | 107365786 A | 11/2017 |
| CN | 107365804 A | 11/2017 |
| CN | 107384894 A | 11/2017 |
| CN | 107384922 A | 11/2017 |
| CN | 107384926 A | 11/2017 |
| CN | 107400677 A | 11/2017 |
| CN | 107418974 A | 12/2017 |
| CN | 107435051 A | 12/2017 |
| CN | 107435069 A | 12/2017 |
| CN | 107446922 A | 12/2017 |
| CN | 107446923 A | 12/2017 |
| CN | 107446924 A | 12/2017 |
| CN | 107446932 A | 12/2017 |
| CN | 107446951 A | 12/2017 |
| CN | 107446954 A | 12/2017 |
| CN | 107460196 A | 12/2017 |
| CN | 107474129 A | 12/2017 |
| CN | 107475300 A | 12/2017 |
| CN | 107488649 A | 12/2017 |
| CN | 107502608 A | 12/2017 |
| CN | 107502618 A | 12/2017 |
| CN | 107513531 A | 12/2017 |
| CN | 107519492 A | 12/2017 |
| CN | 107523567 A | 12/2017 |
| CN | 107523583 A | 12/2017 |
| CN | 107541525 A | 1/2018 |
| CN | 107557373 A | 1/2018 |
| CN | 107557378 A | 1/2018 |
| CN | 107557381 A | 1/2018 |
| CN | 107557390 A | 1/2018 |
| CN | 107557393 A | 1/2018 |
| CN | 107557394 A | 1/2018 |
| CN | 107557455 A | 1/2018 |
| CN | 107574179 A | 1/2018 |
| CN | 107586777 A | 1/2018 |
| CN | 107586779 A | 1/2018 |
| CN | 107604003 A | 1/2018 |
| CN | 107619829 A | 1/2018 |
| CN | 107619837 A | 1/2018 |
| CN | 107630006 A | 1/2018 |
| CN | 107630041 A | 1/2018 |
| CN | 107630042 A | 1/2018 |
| CN | 107630043 A | 1/2018 |
| CN | 107641631 A | 1/2018 |
| CN | 107653256 A | 2/2018 |
| CN | 107686848 A | 2/2018 |
| CN | 206970581 A | 2/2018 |

(56) References Cited

FOREIGN PATENT DOCUMENTS

| | | |
|---|---|---|
| CN | 206970581 U | 2/2018 |
| CN | 107760652 A | 3/2018 |
| CN | 107760663 A | 3/2018 |
| CN | 107760684 A | 3/2018 |
| CN | 107760715 A | 3/2018 |
| CN | 107784200 A | 3/2018 |
| CN | 107794272 A | 3/2018 |
| CN | 107794276 A | 3/2018 |
| CN | 107815463 A | 3/2018 |
| CN | 107828738 A | 3/2018 |
| CN | 107828794 A | 3/2018 |
| CN | 107828826 A | 3/2018 |
| CN | 107828874 A | 3/2018 |
| CN | 107858346 A | 3/2018 |
| CN | 107858373 A | 3/2018 |
| CN | 107880132 A | 4/2018 |
| CN | 107881184 A | 4/2018 |
| CN | 107893074 A | 4/2018 |
| CN | 107893075 A | 4/2018 |
| CN | 107893076 A | 4/2018 |
| CN | 107893080 A | 4/2018 |
| CN | 107893086 A | 4/2018 |
| CN | 107904261 A | 4/2018 |
| CN | 107937427 A | 4/2018 |
| CN | 107937432 A | 4/2018 |
| CN | 107937501 A | 4/2018 |
| CN | 107974466 A | 5/2018 |
| CN | 107988229 A | 5/2018 |
| CN | 107988246 A | 5/2018 |
| CN | 107988256 A | 5/2018 |
| CN | 107988268 A | 5/2018 |
| CN | 108018316 A | 5/2018 |
| CN | 108034656 A | 5/2018 |
| CN | 108048466 A | 5/2018 |
| CN | 108102940 A | 6/2018 |
| CN | 108103090 A | 6/2018 |
| CN | 108103092 A | 6/2018 |
| CN | 108103098 A | 6/2018 |
| CN | 108103586 A | 6/2018 |
| CN | 108148835 A | 6/2018 |
| CN | 108148837 A | 6/2018 |
| CN | 108148873 A | 6/2018 |
| CN | 108192956 A | 6/2018 |
| CN | 108251423 A | 7/2018 |
| CN | 108251451 A | 7/2018 |
| CN | 108251452 A | 7/2018 |
| CN | 108342480 A | 7/2018 |
| CN | 108359691 A | 8/2018 |
| CN | 108359712 A | 8/2018 |
| CN | 108384784 A | 8/2018 |
| CN | 108396027 A | 8/2018 |
| CN | 108410877 A | 8/2018 |
| CN | 108410906 A | 8/2018 |
| CN | 108410907 A | 8/2018 |
| CN | 108410911 A | 8/2018 |
| CN | 108424931 A | 8/2018 |
| CN | 108441519 A | 8/2018 |
| CN | 108441520 A | 8/2018 |
| CN | 108486108 A | 9/2018 |
| CN | 108486111 A | 9/2018 |
| CN | 108486145 A | 9/2018 |
| CN | 108486146 A | 9/2018 |
| CN | 108486154 A | 9/2018 |
| CN | 108486159 A | 9/2018 |
| CN | 108486234 A | 9/2018 |
| CN | 108504657 A | 9/2018 |
| CN | 108504685 A | 9/2018 |
| CN | 108504693 A | 9/2018 |
| CN | 108546712 A | 9/2018 |
| CN | 108546717 A | 9/2018 |
| CN | 108546718 A | 9/2018 |
| CN | 108559730 A | 9/2018 |
| CN | 108559732 A | 9/2018 |
| CN | 108559745 A | 9/2018 |
| CN | 108559760 A | 9/2018 |
| CN | 108570479 A | 9/2018 |
| CN | 108588071 A | 9/2018 |
| CN | 108588123 A | 9/2018 |
| CN | 108588128 A | 9/2018 |
| CN | 108588182 A | 9/2018 |
| CN | 108610399 A | 10/2018 |
| CN | 108611364 A | 10/2018 |
| CN | 108624622 A | 10/2018 |
| CN | 108642053 A | 10/2018 |
| CN | 108642055 A | 10/2018 |
| CN | 108642077 A | 10/2018 |
| CN | 108642078 A | 10/2018 |
| CN | 108642090 A | 10/2018 |
| CN | 108690844 A | 10/2018 |
| CN | 108707604 A | 10/2018 |
| CN | 108707620 A | 10/2018 |
| CN | 108707621 A | 10/2018 |
| CN | 108707628 A | 10/2018 |
| CN | 108707629 A | 10/2018 |
| CN | 108715850 A | 10/2018 |
| CN | 108728476 A | 11/2018 |
| CN | 108728486 A | 11/2018 |
| CN | 108753772 A | 11/2018 |
| CN | 108753783 A | 11/2018 |
| CN | 108753813 A | 11/2018 |
| CN | 108753817 A | 11/2018 |
| CN | 108753832 A | 11/2018 |
| CN | 108753835 A | 11/2018 |
| CN | 108753836 A | 11/2018 |
| CN | 108795902 A | 11/2018 |
| CN | 108822217 A | 11/2018 |
| CN | 108823248 A | 11/2018 |
| CN | 108823249 A | 11/2018 |
| CN | 108823291 A | 11/2018 |
| CN | 108841845 A | 11/2018 |
| CN | 108853133 A | 11/2018 |
| CN | 108866093 A | 11/2018 |
| CN | 108893529 A | 11/2018 |
| CN | 108913664 A | 11/2018 |
| CN | 108913691 A | 11/2018 |
| CN | 108913714 A | 11/2018 |
| CN | 108913717 A | 11/2018 |
| CN | 208034188 U | 11/2018 |
| CN | 109517841 A | 3/2019 |
| EP | 0264166 A1 | 4/1988 |
| EP | 321201 B2 | 6/1989 |
| EP | 519463 A1 | 12/1992 |
| EP | 2604255 A1 | 6/2013 |
| EP | 2840140 A1 | 2/2015 |
| EP | 2877490 A2 | 6/2015 |
| EP | 2966170 A1 | 1/2016 |
| EP | 3009511 A2 | 4/2016 |
| EP | 3031921 A1 | 6/2016 |
| EP | 3045537 A1 | 7/2016 |
| EP | 3115457 A | 1/2017 |
| EP | 3115457 A1 | 1/2017 |
| EP | 3144390 A1 | 3/2017 |
| EP | 3199632 A1 | 8/2017 |
| EP | 3216867 A1 | 9/2017 |
| EP | 3252160 A1 | 12/2017 |
| EP | 3450553 B1 | 12/2019 |
| ES | 2740248 T3 | 2/2020 |
| GB | 2528177 A | 1/2016 |
| GB | 2531454 A | 4/2016 |
| GB | 2531454 A1 | 4/2016 |
| GB | 2542653 A | 3/2017 |
| HK | 1208045 A1 | 2/2016 |
| JP | 2007-501626 A | 2/2007 |
| JP | 2008-515405 A | 5/2008 |
| JP | 2010-033344 A | 2/2010 |
| JP | 2010-535744 A | 11/2010 |
| JP | 2010-539929 A | 12/2010 |
| JP | 2011-081011 A | 4/2011 |
| JP | 2011-523353 A | 8/2011 |
| JP | 2012-525146 A | 10/2012 |
| JP | 2012-210172 A | 11/2012 |
| JP | 2012-531909 A | 12/2012 |
| JP | 2015-523856 A | 8/2015 |
| JP | 2015-532654 A | 11/2015 |

(56) References Cited

FOREIGN PATENT DOCUMENTS

| | | | |
|---|---|---|---|
| JP | 2016-525888 A | 9/2016 |
| JP | 2016-534132 A | 11/2016 |
| JP | 2017-500035 A | 1/2017 |
| JP | 2018-521045 A | 8/2018 |
| JP | 6629734 B2 | 1/2020 |
| KR | 101584933 B1 | 1/2016 |
| KR | 2016-0050069 A | 5/2016 |
| KR | 20160133380 A | 11/2016 |
| KR | 20170037025 A | 4/2017 |
| KR | 20170037028 A | 4/2017 |
| KR | 101748575 B1 | 6/2017 |
| KR | 20170128137 A | 11/2017 |
| KR | 2018-0022465 A | 3/2018 |
| RU | 2016104674 A | 8/2017 |
| RU | 2634395 C1 | 10/2017 |
| RU | 2652899 C1 | 5/2018 |
| RU | 2015128057 A | 3/2019 |
| RU | 2015128098 A | 3/2019 |
| RU | 2687451 C1 | 5/2019 |
| RU | 2019112514 A | 6/2019 |
| RU | 2019127300 A | 9/2019 |
| RU | 2701850 C2 | 10/2019 |
| SG | 10201707569 Y | 10/2017 |
| SG | 10201710486X | 1/2018 |
| SG | 10201710487 | 1/2018 |
| SG | 10201710488 T | 1/2018 |
| TW | I608100 B | 12/2017 |
| TW | 2018-29773 A | 8/2018 |
| WO | WO 1990/002809 | 3/1990 |
| WO | WO 1990/002809 A1 | 3/1990 |
| WO | WO 1991/003162 A1 | 3/1991 |
| WO | WO 1991/016024 A1 | 10/1991 |
| WO | WO 1991/017271 A1 | 11/1991 |
| WO | WO 1991/017424 A1 | 11/1991 |
| WO | WO 1992/006188 A2 | 4/1992 |
| WO | WO 1992/006200 A1 | 4/1992 |
| WO | WO 1992/007065 A1 | 4/1992 |
| WO | WO 1993/015187 A1 | 8/1993 |
| WO | WO 1993/024641 A2 | 12/1993 |
| WO | WO 1994/018316 A2 | 8/1994 |
| WO | WO 1994/026877 A1 | 11/1994 |
| WO | WO 1996/004403 A1 | 2/1996 |
| WO | WO 1996/010640 A1 | 4/1996 |
| WO | WO 1998/032845 A1 | 7/1998 |
| WO | WO 2001/036452 A2 | 5/2001 |
| WO | WO 2001/038547 A2 | 5/2001 |
| WO | WO 2002/059296 A2 | 8/2002 |
| WO | WO 2002/068676 A2 | 9/2002 |
| WO | WO 2002/103028 A2 | 12/2002 |
| WO | WO 2004/007684 A2 | 1/2004 |
| WO | WO 2005/014791 A2 | 2/2005 |
| WO | WO 2005/019415 A2 | 3/2005 |
| WO | WO 2006/002547 A1 | 1/2006 |
| WO | WO 2005/014791 A3 | 2/2006 |
| WO | WO 2006/042112 A2 | 4/2006 |
| WO | WO 2007/025097 A2 | 3/2007 |
| WO | WO 2007/037444 A1 | 4/2007 |
| WO | WO 2007/066923 A1 | 6/2007 |
| WO | WO 2007/136815 A2 | 11/2007 |
| WO | WO 2007/143574 A1 | 12/2007 |
| WO | WO 2008/005529 A2 | 1/2008 |
| WO | WO 2008/108989 A2 | 9/2008 |
| WO | WO 2009/002418 A2 | 12/2008 |
| WO | WO 2009/098290 A1 | 8/2009 |
| WO | WO 2009/134808 A2 | 11/2009 |
| WO | WO 2010/011961 A2 | 1/2010 |
| WO | WO 2010/012902 A1 | 2/2010 |
| WO | WO 2010/028347 A2 | 3/2010 |
| WO | WO 2010/054108 A2 | 5/2010 |
| WO | WO 2010/054154 A2 | 5/2010 |
| WO | WO 2010/068289 A2 | 6/2010 |
| WO | WO 2010/075424 A2 | 7/2010 |
| WO | WO 2010/102257 A2 | 9/2010 |
| WO | WO 2010/104749 A2 | 9/2010 |
| WO | WO 2010/129019 A2 | 11/2010 |
| WO | WO 2010/129023 A2 | 11/2010 |
| WO | WO 2010/132092 A2 | 11/2010 |
| WO | WO 2010/144150 A2 | 12/2010 |
| WO | WO 2011/002503 A1 | 1/2011 |
| WO | WO 2011/017293 A2 | 2/2011 |
| WO | WO 2011/053868 A1 | 5/2011 |
| WO | WO 2011/053982 A1 | 5/2011 |
| WO | WO 2011/068810 A1 | 6/2011 |
| WO | WO 2011/075627 A1 | 6/2011 |
| WO | WO 2011/091311 A2 | 7/2011 |
| WO | WO 2011/091396 A1 | 7/2011 |
| WO | WO 2011/109031 A1 | 9/2011 |
| WO | WO 2011/143124 A2 | 11/2011 |
| WO | WO 2011/147590 A2 | 12/2011 |
| WO | WO 2011/159369 A1 | 12/2011 |
| WO | WO 2012/054726 A1 | 4/2012 |
| WO | WO 2012/065043 A2 | 5/2012 |
| WO | WO 2012/088381 A2 | 6/2012 |
| WO | WO 2012/125445 A2 | 9/2012 |
| WO | WO 2012/138927 A2 | 10/2012 |
| WO | WO 2012/149470 A1 | 11/2012 |
| WO | WO 2012/158985 A2 | 11/2012 |
| WO | WO 2012/158986 A2 | 11/2012 |
| WO | WO 2012/164565 A1 | 12/2012 |
| WO | WO 2012/170930 A2 | 12/2012 |
| WO | WO 2013/012674 A1 | 1/2013 |
| WO | WO 2013/013105 A1 | 1/2013 |
| WO | WO 2013/013105 A2 | 1/2013 |
| WO | WO 2013/039857 A1 | 3/2013 |
| WO | WO 2013/039861 A2 | 3/2013 |
| WO | WO 2013/045632 A1 | 4/2013 |
| WO | WO 2013/047844 A1 | 4/2013 |
| WO | WO 2013/066438 A2 | 5/2013 |
| WO | WO 2013/086441 A2 | 6/2013 |
| WO | WO 2013/086444 A2 | 6/2013 |
| WO | WO 2013/098244 A1 | 7/2013 |
| WO | WO 2013/119602 A1 | 8/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142578 A1 | 9/2013 |
| WO | WO 2013/142578 A2 | 9/2013 |
| WO | WO 2013/152359 A1 | 10/2013 |
| WO | WO 2013/160230 A1 | 10/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A1 | 11/2013 |
| WO | WO 2013/176772 A2 | 11/2013 |
| WO | WO 2013/176915 A1 | 11/2013 |
| WO | WO 2013/176916 A1 | 11/2013 |
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2013/192278 A1 | 12/2013 |
| WO | WO 2013/142378 A9 | 1/2014 |
| WO | WO 2014/004336 A2 | 1/2014 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/020608 A1 | 2/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039585 A2 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/055782 A1 | 4/2014 |

(56) References Cited

FOREIGN PATENT DOCUMENTS

| | | |
|---|---|---|
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/093736 A1 | 6/2014 |
| WO | WO 2014/093768 A1 | 6/2014 |
| WO | WO 2014/093852 A1 | 6/2014 |
| WO | WO 2014/096972 A2 | 6/2014 |
| WO | WO 2014/099744 A1 | 6/2014 |
| WO | WO 2014/099750 A2 | 6/2014 |
| WO | WO 2014/104878 A1 | 7/2014 |
| WO | WO 2014/110006 A1 | 7/2014 |
| WO | WO 2014/110552 A1 | 7/2014 |
| WO | WO 2014/113493 A1 | 7/2014 |
| WO | WO 2014/123967 A2 | 8/2014 |
| WO | WO 2014/124226 A1 | 8/2014 |
| WO | WO 2014/125668 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130706 A1 | 8/2014 |
| WO | WO 2014/130955 A1 | 8/2014 |
| WO | WO 2014/131833 A1 | 9/2014 |
| WO | WO 2014/138379 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/144951 A1 | 9/2014 |
| WO | WO 2014/145599 A2 | 9/2014 |
| WO | WO 2014/145736 A2 | 9/2014 |
| WO | WO 2014/150624 A1 | 9/2014 |
| WO | WO 2014/152432 A2 | 9/2014 |
| WO | WO 2014/152940 A1 | 9/2014 |
| WO | WO 2014/153118 A1 | 9/2014 |
| WO | WO 2014/153470 A2 | 9/2014 |
| WO | WO 2014/158593 A1 | 10/2014 |
| WO | WO 2014/161821 A1 | 10/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165612 A2 | 10/2014 |
| WO | WO 2014/165707 A2 | 10/2014 |
| WO | WO 2014/165825 A2 | 10/2014 |
| WO | WO 2014/172458 A1 | 10/2014 |
| WO | WO 2014/172470 A2 | 10/2014 |
| WO | WO 2014/172489 A2 | 10/2014 |
| WO | WO 2014/173955 A1 | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/193583 A2 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/199358 A1 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2014/205192 A2 | 12/2014 |
| WO | WO 2014/207043 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006437 A1 | 1/2015 |
| WO | WO 2015/006498 A2 | 1/2015 |
| WO | WO 2015/006747 A2 | 1/2015 |
| WO | WO 2015/007194 A1 | 1/2015 |
| WO | WO 2015/010114 A1 | 1/2015 |
| WO | WO 2015/011483 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/024986 A1 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/028969 A2 | 3/2015 |
| WO | WO 2015/030881 A1 | 3/2015 |
| WO | WO 2015/031619 A1 | 3/2015 |
| WO | WO 2015/031775 A1 | 3/2015 |
| WO | WO 2015/032494 A2 | 3/2015 |
| WO | WO 2015/033293 A1 | 3/2015 |
| WO | WO 2015/034872 A2 | 3/2015 |
| WO | WO 2015/034885 A1 | 3/2015 |
| WO | WO 2015/035136 A1 | 3/2015 |
| WO | WO 2015/035139 A2 | 3/2015 |
| WO | WO 2015/035162 A2 | 3/2015 |
| WO | WO 2015/040075 A1 | 3/2015 |
| WO | WO 2015/040402 A1 | 3/2015 |
| WO | WO 2015/042393 A1 | 3/2015 |
| WO | WO 2015/042585 A1 | 3/2015 |
| WO | WO 2015/048577 A2 | 4/2015 |
| WO | WO 2015/048690 A1 | 4/2015 |
| WO | WO 2015/048707 A2 | 4/2015 |
| WO | WO 2015/048801 A2 | 4/2015 |
| WO | WO 2015/049897 A1 | 4/2015 |
| WO | WO 2015/051191 A1 | 4/2015 |

(56) References Cited

FOREIGN PATENT DOCUMENTS

| | | |
|---|---|---|
| WO | WO 2015/052133 A1 | 4/2015 |
| WO | WO 2015/052231 A2 | 4/2015 |
| WO | WO 2015/052335 A1 | 4/2015 |
| WO | WO 2015/053995 A1 | 4/2015 |
| WO | WO 2015/054253 A1 | 4/2015 |
| WO | WO 2015/054315 A1 | 4/2015 |
| WO | WO 2015/057671 A1 | 4/2015 |
| WO | WO 2015/057834 A1 | 4/2015 |
| WO | WO 2015/057852 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066634 A2 | 5/2015 |
| WO | WO 2015/066636 A2 | 5/2015 |
| WO | WO 2015/066637 A1 | 5/2015 |
| WO | WO 2015/066638 A2 | 5/2015 |
| WO | WO 2015/066643 A1 | 5/2015 |
| WO | WO 2015/069682 A2 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |
| WO | WO 2015/073867 A1 | 5/2015 |
| WO | WO 2015/073990 A1 | 5/2015 |
| WO | WO 2015/075056 A1 | 5/2015 |
| WO | WO 2015/075154 A2 | 5/2015 |
| WO | WO 2015/075175 A1 | 5/2015 |
| WO | WO 2015/075195 A1 | 5/2015 |
| WO | WO 2015/075557 A2 | 5/2015 |
| WO | WO 2015/077058 A2 | 5/2015 |
| WO | WO 2015/077290 A2 | 5/2015 |
| WO | WO 2015/077318 A1 | 5/2015 |
| WO | WO 2015/079056 A1 | 6/2015 |
| WO | WO 2015/079057 A2 | 6/2015 |
| WO | WO 2015/086795 A1 | 6/2015 |
| WO | WO 2015/086798 A2 | 6/2015 |
| WO | WO 2015/088643 A1 | 6/2015 |
| WO | WO 2015/089046 A1 | 6/2015 |
| WO | WO 2015/089077 A2 | 6/2015 |
| WO | WO 2015/089277 A1 | 6/2015 |
| WO | WO 2015/089351 A1 | 6/2015 |
| WO | WO 2015/089354 A1 | 6/2015 |
| WO | WO 2015/089364 A1 | 6/2015 |
| WO | WO 2015/089406 A1 | 6/2015 |
| WO | WO 2015/089419 A2 | 6/2015 |
| WO | WO 2015/089427 A1 | 6/2015 |
| WO | WO 2015/089462 A1 | 6/2015 |
| WO | WO 2015/089465 A1 | 6/2015 |
| WO | WO 2015/089473 A1 | 6/2015 |
| WO | WO 2015/089486 A2 | 6/2015 |
| WO | WO 2015/095804 A1 | 6/2015 |
| WO | WO 2015/099850 A1 | 7/2015 |
| WO | WO 2015/100929 A1 | 7/2015 |
| WO | WO 2015/103057 A1 | 7/2015 |
| WO | WO 2015/103153 A1 | 7/2015 |
| WO | WO 2015/105928 A1 | 7/2015 |
| WO | WO 2015/108993 A1 | 7/2015 |
| WO | WO 2015/109752 A1 | 7/2015 |
| WO | WO 2015/110474 A1 | 7/2015 |
| WO | WO 2015/112790 A2 | 7/2015 |
| WO | WO 2015/112896 A2 | 7/2015 |
| WO | WO 2015/113063 A1 | 7/2015 |
| WO | WO 2015/114365 A1 | 8/2015 |
| WO | WO 2015/115903 A1 | 8/2015 |
| WO | WO 2015/116686 A1 | 8/2015 |
| WO | WO 2015/116969 A2 | 8/2015 |
| WO | WO 2015/117021 A1 | 8/2015 |
| WO | WO 2015/117041 A1 | 8/2015 |
| WO | WO 2015/117081 A2 | 8/2015 |
| WO | WO 2015/118156 A1 | 8/2015 |
| WO | WO 2015/119941 A2 | 8/2015 |
| WO | WO 2015/121454 A1 | 8/2015 |
| WO | WO 2015/122967 A1 | 8/2015 |
| WO | WO 2015/123339 A1 | 8/2015 |
| WO | WO 2015/124715 A1 | 8/2015 |
| WO | WO 2015/124718 A1 | 8/2015 |
| WO | WO 2015/126927 A2 | 8/2015 |
| WO | WO 2015/127428 A1 | 8/2015 |
| WO | WO 2015/127439 A1 | 8/2015 |
| WO | WO 2015/129686 A1 | 9/2015 |
| WO | WO 2015/131101 A1 | 9/2015 |
| WO | WO 2015/133554 A1 | 9/2015 |
| WO | WO 2015/134121 A2 | 9/2015 |
| WO | WO 2015/134812 A1 | 9/2015 |
| WO | WO 2015/136001 A1 | 9/2015 |
| WO | WO 2015/138510 A1 | 9/2015 |
| WO | WO 2015/138739 A2 | 9/2015 |
| WO | WO 2015/138855 A1 | 9/2015 |
| WO | WO 2015/138870 A2 | 9/2015 |
| WO | WO 2015/139008 A1 | 9/2015 |
| WO | WO 2015/139139 A1 | 9/2015 |
| WO | WO 2015/143046 A2 | 9/2015 |
| WO | WO 2015/143177 A1 | 9/2015 |
| WO | WO 2015/145417 A1 | 10/2015 |
| WO | WO 2015/148431 A1 | 10/2015 |
| WO | WO 2015/148670 A1 | 10/2015 |
| WO | WO 2015/148680 A1 | 10/2015 |
| WO | WO 2015/148760 A1 | 10/2015 |
| WO | WO 2015/148761 A1 | 10/2015 |
| WO | WO 2015/148860 A1 | 10/2015 |
| WO | WO 2015/148863 A2 | 10/2015 |
| WO | WO 2015/153760 A2 | 10/2015 |
| WO | WO 2015/153780 A1 | 10/2015 |
| WO | WO 2015/153789 A1 | 10/2015 |
| WO | WO 2015/153791 A1 | 10/2015 |
| WO | WO 2015/153889 A2 | 10/2015 |
| WO | WO 2015/153940 A1 | 10/2015 |
| WO | WO 2015/155341 A1 | 10/2015 |
| WO | WO 2015/155686 A2 | 10/2015 |
| WO | WO 2015/157070 A2 | 10/2015 |
| WO | WO 2015/157534 A1 | 10/2015 |
| WO | WO 2015/159068 A1 | 10/2015 |
| WO | WO 2015/159086 A1 | 10/2015 |
| WO | WO 2015/159087 A1 | 10/2015 |
| WO | WO 2015/160683 A1 | 10/2015 |
| WO | WO 2015/161276 A2 | 10/2015 |
| WO | WO 2015/163733 A1 | 10/2015 |
| WO | WO 2015/164740 A1 | 10/2015 |
| WO | WO 2015/164748 A1 | 10/2015 |
| WO | WO 2015/165274 A1 | 11/2015 |
| WO | WO 2015/165275 A1 | 11/2015 |
| WO | WO 2015/165276 A1 | 11/2015 |
| WO | WO 2015/166272 A2 | 11/2015 |
| WO | WO 2015/167766 A1 | 11/2015 |
| WO | WO 2015/167956 A1 | 11/2015 |
| WO | WO 2015/168125 A1 | 11/2015 |
| WO | WO 2015/168158 A1 | 11/2015 |
| WO | WO 2015/168404 A1 | 11/2015 |
| WO | WO 2015/168547 A2 | 11/2015 |
| WO | WO 2015/168800 A1 | 11/2015 |
| WO | WO 2015/171603 A1 | 11/2015 |
| WO | WO 2015/171894 A1 | 11/2015 |
| WO | WO 2015/171932 A1 | 11/2015 |
| WO | WO 2015/172128 A1 | 11/2015 |
| WO | WO 2015/173436 A1 | 11/2015 |
| WO | WO 2015/175642 A2 | 11/2015 |
| WO | WO 2015/179540 A1 | 11/2015 |
| WO | WO 2015/183025 A1 | 12/2015 |
| WO | WO 2015/183026 A1 | 12/2015 |
| WO | WO 2015/183885 A1 | 12/2015 |
| WO | WO 2015/184259 A1 | 12/2015 |
| WO | WO 2015/184262 A1 | 12/2015 |
| WO | WO 2015/184268 A1 | 12/2015 |
| WO | WO 2015/188056 A1 | 12/2015 |
| WO | WO 2015/188065 A1 | 12/2015 |
| WO | WO 2015/188094 A1 | 12/2015 |
| WO | WO 2015/188109 A1 | 12/2015 |
| WO | WO 2015/188132 A1 | 12/2015 |
| WO | WO 2015/188135 A1 | 12/2015 |
| WO | WO 2015/188191 A1 | 12/2015 |
| WO | WO 2015/189693 A1 | 12/2015 |

(56) References Cited

FOREIGN PATENT DOCUMENTS

| | | |
|---|---|---|
| WO | WO 2015/191693 A2 | 12/2015 |
| WO | WO 2015/191899 A1 | 12/2015 |
| WO | WO 2015/191911 A2 | 12/2015 |
| WO | WO 2015/193858 A1 | 12/2015 |
| WO | WO 2015/195547 A1 | 12/2015 |
| WO | WO 2015/195621 A1 | 12/2015 |
| WO | WO 2015/195798 A1 | 12/2015 |
| WO | WO 2015/198020 A1 | 12/2015 |
| WO | WO 2015/200334 A1 | 12/2015 |
| WO | WO 2015/200378 A1 | 12/2015 |
| WO | WO 2015/200555 A2 | 12/2015 |
| WO | WO 2015/200805 A2 | 12/2015 |
| WO | WO 2016/001978 A1 | 1/2016 |
| WO | WO 2016/004010 A1 | 1/2016 |
| WO | WO 2016/004318 A1 | 1/2016 |
| WO | WO 2016/007347 A1 | 1/2016 |
| WO | WO 2016/007604 A1 | 1/2016 |
| WO | WO 2016/007948 A1 | 1/2016 |
| WO | WO 2016/011080 A2 | 1/2016 |
| WO | WO 2016/011210 A2 | 1/2016 |
| WO | WO 2016/011428 A1 | 1/2016 |
| WO | WO 2016/012544 A2 | 1/2016 |
| WO | WO 2016/012552 A1 | 1/2016 |
| WO | WO 2016/014409 A1 | 1/2016 |
| WO | WO 2016/014565 A2 | 1/2016 |
| WO | WO 2016/014794 A1 | 1/2016 |
| WO | WO 2016/014837 A1 | 1/2016 |
| WO | WO 2016/016119 A1 | 2/2016 |
| WO | WO 2016/016358 A1 | 2/2016 |
| WO | WO 2016/019144 A2 | 2/2016 |
| WO | WO 2016/020399 A1 | 2/2016 |
| WO | WO 2016/021972 A1 | 2/2016 |
| WO | WO 2016/021973 A1 | 2/2016 |
| WO | WO 2016/022363 A2 | 2/2016 |
| WO | WO 2016/022866 A1 | 2/2016 |
| WO | WO 2016/022931 A1 | 2/2016 |
| WO | WO 2016/025131 A1 | 2/2016 |
| WO | WO 2016/025469 A1 | 2/2016 |
| WO | WO 2016/025759 A1 | 2/2016 |
| WO | WO 2016/026444 A1 | 2/2016 |
| WO | WO 2016/028682 A1 | 2/2016 |
| WO | WO 2016/028843 A2 | 2/2016 |
| WO | WO 2016/028887 A1 | 2/2016 |
| WO | WO 2016/033088 A1 | 3/2016 |
| WO | WO 2016/033230 A1 | 3/2016 |
| WO | WO 2016/033246 A1 | 3/2016 |
| WO | WO 2016/033298 A1 | 3/2016 |
| WO | WO 2016/035044 A1 | 3/2016 |
| WO | WO 2016/036754 A1 | 3/2016 |
| WO | WO 2016/037157 A2 | 3/2016 |
| WO | WO 2016/040030 A1 | 3/2016 |
| WO | WO 2016/040594 A1 | 3/2016 |
| WO | WO 2016/044182 A1 | 3/2016 |
| WO | WO 2016/044416 A1 | 3/2016 |
| WO | WO 2016/046635 A1 | 3/2016 |
| WO | WO 2016/049024 A2 | 3/2016 |
| WO | WO 2016/049163 A2 | 3/2016 |
| WO | WO 2016/049230 A1 | 3/2016 |
| WO | WO 2016/049251 A1 | 3/2016 |
| WO | WO 2016/049258 A2 | 3/2016 |
| WO | WO 2016/053397 A2 | 4/2016 |
| WO | WO 2016/054326 A1 | 4/2016 |
| WO | WO 2016/057061 A2 | 4/2016 |
| WO | WO 2016/057821 A2 | 4/2016 |
| WO | WO 2016/057835 A2 | 4/2016 |
| WO | WO 2016/057850 A1 | 4/2016 |
| WO | WO 2016/057951 A2 | 4/2016 |
| WO | WO 2016/057961 A1 | 4/2016 |
| WO | WO 2016/061073 A1 | 4/2016 |
| WO | WO 2016/061374 A1 | 4/2016 |
| WO | WO 2016/061481 A1 | 4/2016 |
| WO | WO 2016/061523 A1 | 4/2016 |
| WO | WO 2016/064894 A2 | 4/2016 |
| WO | WO 2016/065364 A1 | 4/2016 |
| WO | WO 2016/069282 A1 | 5/2016 |
| WO | WO 2016/069283 A1 | 5/2016 |
| WO | WO 2016/069591 A2 | 5/2016 |
| WO | WO 2016/069774 A1 | 5/2016 |
| WO | WO 2016/069910 A1 | 5/2016 |
| WO | WO 2016/069912 A1 | 5/2016 |
| WO | WO 2016/070037 A2 | 5/2016 |
| WO | WO 2016/070070 A1 | 5/2016 |
| WO | WO 2016/070129 A1 | 5/2016 |
| WO | WO 2016/072399 A1 | 5/2016 |
| WO | WO 2016/072936 A1 | 5/2016 |
| WO | WO 2016/073433 A1 | 5/2016 |
| WO | WO 2016/073559 A1 | 5/2016 |
| WO | WO 2016/073990 A2 | 5/2016 |
| WO | WO 2016/075662 A2 | 5/2016 |
| WO | WO 2016/076672 A1 | 5/2016 |
| WO | WO 2016/077273 A1 | 5/2016 |
| WO | WO 2016/077350 A1 | 5/2016 |
| WO | WO 2016/080097 A1 | 5/2016 |
| WO | WO 2016/080795 A1 | 5/2016 |
| WO | WO 2016/081923 A2 | 5/2016 |
| WO | WO 2016/081924 A1 | 5/2016 |
| WO | WO 2016/082135 A1 | 6/2016 |
| WO | WO 2016/083811 A1 | 6/2016 |
| WO | WO 2016/084084 A1 | 6/2016 |
| WO | WO 2016/084088 A1 | 6/2016 |
| WO | WO 2016/086177 A2 | 6/2016 |
| WO | WO 2016/089433 A1 | 6/2016 |
| WO | WO 2016/089866 A1 | 6/2016 |
| WO | WO 2016/089883 A1 | 6/2016 |
| WO | WO 2016/090385 A1 | 6/2016 |
| WO | WO 2016/094679 A1 | 6/2016 |
| WO | WO 2016/094845 A2 | 6/2016 |
| WO | WO 2016/094867 A1 | 6/2016 |
| WO | WO 2016/094872 A2 | 6/2016 |
| WO | WO 2016/094874 A1 | 6/2016 |
| WO | WO 2016/094880 A1 | 6/2016 |
| WO | WO 2016/094888 A1 | 6/2016 |
| WO | WO 2016/097212 A1 | 6/2016 |
| WO | WO 2016/097231 A2 | 6/2016 |
| WO | WO 2016/097751 A1 | 6/2016 |
| WO | WO 2016/099887 A1 | 6/2016 |
| WO | WO 2016/100272 A1 | 6/2016 |
| WO | WO 2016/100389 A1 | 6/2016 |
| WO | WO 2016/100568 A1 | 6/2016 |
| WO | WO 2016/100571 A1 | 6/2016 |
| WO | WO 2016/100951 A2 | 6/2016 |
| WO | WO 2016/100955 A2 | 6/2016 |
| WO | WO 2016/100974 A1 | 6/2016 |
| WO | WO 2016/103233 A2 | 6/2016 |
| WO | WO 2016/104716 A1 | 6/2016 |
| WO | WO 2016/106236 A1 | 6/2016 |
| WO | WO 2016/106239 A1 | 6/2016 |
| WO | WO 2016/106244 A1 | 6/2016 |
| WO | WO 2016/106338 A2 | 6/2016 |
| WO | WO 2016/108926 A1 | 7/2016 |
| WO | WO 2016/109255 A1 | 7/2016 |
| WO | WO 2016/109840 A2 | 7/2016 |
| WO | WO 2016/110214 A1 | 7/2016 |
| WO | WO 2016/110453 A1 | 7/2016 |
| WO | WO 2016/110511 A1 | 7/2016 |
| WO | WO 2016/110512 A1 | 7/2016 |
| WO | WO 2016/111546 A2 | 7/2016 |
| WO | WO 2016/112242 A1 | 7/2016 |
| WO | WO 2016/112351 A1 | 7/2016 |
| WO | WO 2016/112963 A1 | 7/2016 |
| WO | WO 2016/113357 A1 | 7/2016 |
| WO | WO 2016/114972 A1 | 7/2016 |
| WO | WO 2016/115179 A1 | 7/2016 |
| WO | WO 2016/115326 A1 | 7/2016 |
| WO | WO 2016/115355 A1 | 7/2016 |
| WO | WO 2016/116032 A1 | 7/2016 |
| WO | WO 2016/120480 A1 | 8/2016 |
| WO | WO 2016/123071 A1 | 8/2016 |
| WO | WO 2016/123230 A1 | 8/2016 |
| WO | WO 2016/123243 A1 | 8/2016 |
| WO | WO 2016/123578 A1 | 8/2016 |
| WO | WO 2016/126747 A1 | 8/2016 |
| WO | WO 2016/130600 A2 | 8/2016 |
| WO | WO 2016/130697 A1 | 8/2016 |

(56) References Cited

FOREIGN PATENT DOCUMENTS

| | | |
|---|---|---|
| WO | WO 2016/131009 A1 | 8/2016 |
| WO | WO 2016/132122 A1 | 8/2016 |
| WO | WO 2016/133165 A1 | 8/2016 |
| WO | WO 2016/135507 A1 | 9/2016 |
| WO | WO 2016/135557 A2 | 9/2016 |
| WO | WO 2016/135558 A2 | 9/2016 |
| WO | WO 2016/135559 A2 | 9/2016 |
| WO | WO 2016/137774 A1 | 9/2016 |
| WO | WO 2016/137949 A1 | 9/2016 |
| WO | WO 2016/141224 A1 | 9/2016 |
| WO | WO 2016/141893 A1 | 9/2016 |
| WO | WO 2016/142719 A1 | 9/2016 |
| WO | WO 2016/145150 A2 | 9/2016 |
| WO | WO 2016/148994 A1 | 9/2016 |
| WO | WO 2016/149484 A2 | 9/2016 |
| WO | WO 2016/149547 A1 | 9/2016 |
| WO | WO 2016/150336 A1 | 9/2016 |
| WO | WO 2016/150855 A1 | 9/2016 |
| WO | WO 2016/154016 A2 | 9/2016 |
| WO | WO 2016/154579 A2 | 9/2016 |
| WO | WO 2016/154596 A1 | 9/2016 |
| WO | WO 2016/155482 A1 | 10/2016 |
| WO | WO 2016/161004 A1 | 10/2016 |
| WO | WO 2016/161207 A1 | 10/2016 |
| WO | WO 2016/161260 A1 | 10/2016 |
| WO | WO 2016/161380 A1 | 10/2016 |
| WO | WO 2016/161446 A1 | 10/2016 |
| WO | WO 2016/164356 A1 | 10/2016 |
| WO | WO 2016/164797 A1 | 10/2016 |
| WO | WO 2016/166340 A1 | 10/2016 |
| WO | WO 2016/167300 A1 | 10/2016 |
| WO | WO 2016/168631 A1 | 10/2016 |
| WO | WO 2016/170484 A1 | 10/2016 |
| WO | WO 2016/172359 A2 | 10/2016 |
| WO | WO 2016/172727 A1 | 10/2016 |
| WO | WO 2016/174056 A1 | 11/2016 |
| WO | WO 2016/174151 A1 | 11/2016 |
| WO | WO 2016/174250 A1 | 11/2016 |
| WO | WO 2016/176191 A1 | 11/2016 |
| WO | WO 2016/176404 A1 | 11/2016 |
| WO | WO 2016/176690 A2 | 11/2016 |
| WO | WO 2016/177682 A1 | 11/2016 |
| WO | WO 2016/178207 A1 | 11/2016 |
| WO | WO 2016/179038 A1 | 11/2016 |
| WO | WO 2016/179112 A1 | 11/2016 |
| WO | WO 2016/181357 A1 | 11/2016 |
| WO | WO 2016/182893 A1 | 11/2016 |
| WO | WO 2016/182917 A1 | 11/2016 |
| WO | WO 2016/182959 A1 | 11/2016 |
| WO | WO 2016/183236 A1 | 11/2016 |
| WO | WO 2016/183298 A2 | 11/2016 |
| WO | WO 2016/183345 A1 | 11/2016 |
| WO | WO 2016/183402 A2 | 11/2016 |
| WO | WO 2016/183438 A1 | 11/2016 |
| WO | WO 2016/183448 A1 | 11/2016 |
| WO | WO 2016/184955 A2 | 11/2016 |
| WO | WO 2016/184989 A1 | 11/2016 |
| WO | WO 2016/185411 A1 | 11/2016 |
| WO | WO 2016/186745 A1 | 11/2016 |
| WO | WO 2016/186772 A2 | 11/2016 |
| WO | WO 2016/186946 A1 | 11/2016 |
| WO | WO 2016/186953 A1 | 11/2016 |
| WO | WO 2016/187717 A1 | 12/2016 |
| WO | WO 2016/187904 A1 | 12/2016 |
| WO | WO 2016/191684 A1 | 12/2016 |
| WO | WO 2016/191869 A1 | 12/2016 |
| WO | WO 2016/196273 A1 | 12/2016 |
| WO | WO 2016/196282 A1 | 12/2016 |
| WO | WO 2016/196308 A1 | 12/2016 |
| WO | WO 2016/196361 A1 | 12/2016 |
| WO | WO 2016/196499 A1 | 12/2016 |
| WO | WO 2016/196539 A2 | 12/2016 |
| WO | WO 2016/196655 A1 | 12/2016 |
| WO | WO 2016/196805 A1 | 12/2016 |
| WO | WO 2016/196887 A1 | 12/2016 |
| WO | WO 2016/197132 A1 | 12/2016 |
| WO | WO 2016/197133 A1 | 12/2016 |
| WO | WO 2016/197354 A1 | 12/2016 |
| WO | WO 2016/197355 A1 | 12/2016 |
| WO | WO 2016/197356 A1 | 12/2016 |
| WO | WO 2016/197357 A1 | 12/2016 |
| WO | WO 2016/197358 A1 | 12/2016 |
| WO | WO 2016/197359 A1 | 12/2016 |
| WO | WO 2016/197360 A1 | 12/2016 |
| WO | WO 2016/197361 A1 | 12/2016 |
| WO | WO 2016/197362 A1 | 12/2016 |
| WO | WO 2016/198361 A1 | 12/2016 |
| WO | WO 2016/198500 A1 | 12/2016 |
| WO | WO 2016/200263 A1 | 12/2016 |
| WO | WO 2016/201047 A1 | 12/2016 |
| WO | WO 2016/201138 A1 | 12/2016 |
| WO | WO 2016/201152 A1 | 12/2016 |
| WO | WO 2016/201153 A1 | 12/2016 |
| WO | WO 2016/201155 A1 | 12/2016 |
| WO | WO 2016/205276 A1 | 12/2016 |
| WO | WO 2016/205613 A1 | 12/2016 |
| WO | WO 2016/205623 A1 | 12/2016 |
| WO | WO 2016/205680 A1 | 12/2016 |
| WO | WO 2016/205688 A2 | 12/2016 |
| WO | WO 2016/205703 A1 | 12/2016 |
| WO | WO 2016/205711 A1 | 12/2016 |
| WO | WO 2016/205728 A1 | 12/2016 |
| WO | WO 2016/205745 A2 | 12/2016 |
| WO | WO 2016/205749 A1 | 12/2016 |
| WO | WO 2016/205759 A1 | 12/2016 |
| WO | WO 2016/205764 A1 | 12/2016 |
| WO | WO 2017/001572 A1 | 1/2017 |
| WO | WO 2017/001988 A1 | 1/2017 |
| WO | WO 2017/004261 A1 | 1/2017 |
| WO | WO 2017/004279 A2 | 1/2017 |
| WO | WO 2017/004616 A1 | 1/2017 |
| WO | WO 2017/005807 A1 | 1/2017 |
| WO | WO 2017/009399 A1 | 1/2017 |
| WO | WO 2017/010556 A1 | 1/2017 |
| WO | WO 2017/011519 A1 | 1/2017 |
| WO | WO 2017/011721 A1 | 1/2017 |
| WO | WO 2017/011804 A1 | 1/2017 |
| WO | WO 2017/015015 A1 | 1/2017 |
| WO | WO 2017/015101 A1 | 1/2017 |
| WO | WO 2017/015545 A1 | 1/2017 |
| WO | WO 2017/015567 A1 | 1/2017 |
| WO | WO 2017/015637 A1 | 1/2017 |
| WO | WO 2017/017016 A1 | 2/2017 |
| WO | WO 2017/019867 A1 | 2/2017 |
| WO | WO 2017/019895 A1 | 2/2017 |
| WO | WO 2017/023803 A1 | 2/2017 |
| WO | WO 2017/023974 A1 | 2/2017 |
| WO | WO 2017/024047 A1 | 2/2017 |
| WO | WO 2017/024319 A1 | 2/2017 |
| WO | WO 2017/024343 A1 | 2/2017 |
| WO | WO 2017/024602 A1 | 2/2017 |
| WO | WO 2017/025323 A1 | 2/2017 |
| WO | WO 2017/027423 A1 | 2/2017 |
| WO | WO 2017/028768 A1 | 2/2017 |
| WO | WO 2017/029664 A1 | 2/2017 |
| WO | WO 2017/031360 A1 | 2/2017 |
| WO | WO 2017/031483 A1 | 2/2017 |
| WO | WO 2017/035416 A2 | 3/2017 |
| WO | WO 2017/040348 A1 | 3/2017 |
| WO | WO 2017/040511 A1 | 3/2017 |
| WO | WO 2017/040709 A1 | 3/2017 |
| WO | WO 2017/040786 A1 | 3/2017 |
| WO | WO 2017/040793 A1 | 3/2017 |
| WO | WO 2017/040813 A2 | 3/2017 |
| WO | WO 2017/043573 A1 | 3/2017 |
| WO | WO 2017/043656 A1 | 3/2017 |
| WO | WO 2017/044419 A1 | 3/2017 |
| WO | WO 2017/044776 A1 | 3/2017 |
| WO | WO 2017/044857 A2 | 3/2017 |
| WO | WO 2017/048390 A1 | 3/2017 |
| WO | WO 2017/049129 A2 | 3/2017 |
| WO | WO 2017/050963 A1 | 3/2017 |
| WO | WO 2017/053312 A1 | 3/2017 |
| WO | WO 2017/053431 A2 | 3/2017 |

(56) References Cited

FOREIGN PATENT DOCUMENTS

| | | |
|---|---|---|
| WO | WO 2017/053713 A1 | 3/2017 |
| WO | WO 2017/053729 A1 | 3/2017 |
| WO | WO 2017/053753 A1 | 3/2017 |
| WO | WO 2017/053762 A1 | 3/2017 |
| WO | WO 2017/053879 A1 | 3/2017 |
| WO | WO 2017/054721 A1 | 4/2017 |
| WO | WO 2017/058658 A2 | 4/2017 |
| WO | WO 2017/059241 A1 | 4/2017 |
| WO | WO 2017/062605 A1 | 4/2017 |
| WO | WO 2017/062723 A1 | 4/2017 |
| WO | WO 2017/062754 A1 | 4/2017 |
| WO | WO 2017/062855 A1 | 4/2017 |
| WO | WO 2017/062886 A1 | 4/2017 |
| WO | WO 2017/062983 A1 | 4/2017 |
| WO | WO 2017/064439 A1 | 4/2017 |
| WO | WO 2017/064546 A1 | 4/2017 |
| WO | WO 2017/064566 A2 | 4/2017 |
| WO | WO 2017/066175 A1 | 4/2017 |
| WO | WO 2017/066497 A2 | 4/2017 |
| WO | WO 2017/066588 A2 | 4/2017 |
| WO | WO 2017/066707 A1 | 4/2017 |
| WO | WO 2017/066781 A1 | 4/2017 |
| WO | WO 2017/068077 A1 | 4/2017 |
| WO | WO 2017/068377 A1 | 4/2017 |
| WO | WO 2017/069829 A2 | 4/2017 |
| WO | WO 2017/070029 A1 | 4/2017 |
| WO | WO 2017/070032 A1 | 4/2017 |
| WO | WO 2017/070169 A1 | 4/2017 |
| WO | WO 2017/070284 A1 | 4/2017 |
| WO | WO 2017/070598 A1 | 4/2017 |
| WO | WO 2017/070605 A1 | 4/2017 |
| WO | WO 2017/070632 A2 | 4/2017 |
| WO | WO 2017/070633 A2 | 4/2017 |
| WO | WO 2017/072590 A1 | 5/2017 |
| WO | WO 2017/074526 A1 | 5/2017 |
| WO | WO 2017/074962 A1 | 5/2017 |
| WO | WO 2017/075261 A1 | 5/2017 |
| WO | WO 2017/075335 A1 | 5/2017 |
| WO | WO 2017/075475 A1 | 5/2017 |
| WO | WO 2017/077135 A1 | 5/2017 |
| WO | WO 2017/077329 A2 | 5/2017 |
| WO | WO 2017/078751 A1 | 5/2017 |
| WO | WO 2017/079400 A1 | 5/2017 |
| WO | WO 2017/079428 A1 | 5/2017 |
| WO | WO 2017/079673 A1 | 5/2017 |
| WO | WO 2017/079724 A1 | 5/2017 |
| WO | WO 2017/081097 A1 | 5/2017 |
| WO | WO 2017/081288 A1 | 5/2017 |
| WO | WO 2017/083368 A1 | 5/2017 |
| WO | WO 2017/083722 A1 | 5/2017 |
| WO | WO 2017/083766 A1 | 5/2017 |
| WO | WO 2017/087395 A1 | 5/2017 |
| WO | WO 2017/090724 A1 | 6/2017 |
| WO | WO 2017/091510 A1 | 6/2017 |
| WO | WO 2017/091630 A1 | 6/2017 |
| WO | WO 2017/092201 A1 | 6/2017 |
| WO | WO 2017/093370 A1 | 6/2017 |
| WO | WO 2017/093969 A1 | 6/2017 |
| WO | WO 2017/095111 A1 | 6/2017 |
| WO | WO 2017/096041 A1 | 6/2017 |
| WO | WO 2017/096237 A1 | 6/2017 |
| WO | WO 2017/100158 A1 | 6/2017 |
| WO | WO 2017/100431 A2 | 6/2017 |
| WO | WO 2017/104404 A1 | 6/2017 |
| WO | WO 2017/105251 A1 | 6/2017 |
| WO | WO 2017/105350 A1 | 6/2017 |
| WO | WO 2017/105991 A1 | 6/2017 |
| WO | WO 2017/106414 A1 | 6/2017 |
| WO | WO 2017/106528 A2 | 6/2017 |
| WO | WO 2017/106537 A2 | 6/2017 |
| WO | WO 2017/106569 A1 | 6/2017 |
| WO | WO 2017/106616 A1 | 6/2017 |
| WO | WO 2017/106657 A1 | 6/2017 |
| WO | WO 2017/106767 A1 | 6/2017 |
| WO | WO 2017/109134 A1 | 6/2017 |
| WO | WO 2017/109757 A1 | 6/2017 |
| WO | WO 2017/112620 A1 | 6/2017 |
| WO | WO 2017/115268 A1 | 7/2017 |
| WO | WO 2017/117395 A1 | 7/2017 |
| WO | WO 2017/118598 A1 | 7/2017 |
| WO | WO 2017/118720 A1 | 7/2017 |
| WO | WO 2017/123609 A1 | 7/2017 |
| WO | WO 2017/123910 A1 | 7/2017 |
| WO | WO 2017/124086 A1 | 7/2017 |
| WO | WO 2017/124100 A1 | 7/2017 |
| WO | WO 2017/124652 A1 | 7/2017 |
| WO | WO 2017/126987 A1 | 7/2017 |
| WO | WO 2017/127807 A1 | 7/2017 |
| WO | WO 2017/131237 A1 | 8/2017 |
| WO | WO 2017/132112 A1 | 8/2017 |
| WO | WO 2017/132580 A2 | 8/2017 |
| WO | WO 2017/136520 A1 | 8/2017 |
| WO | WO 2017/136629 A1 | 8/2017 |
| WO | WO 2017/136794 A1 | 8/2017 |
| WO | WO 2017/139264 A1 | 8/2017 |
| WO | WO 2017/139505 A2 | 8/2017 |
| WO | WO 2017/141173 A2 | 8/2017 |
| WO | WO 2017/142835 A1 | 8/2017 |
| WO | WO 2017/142999 A2 | 8/2017 |
| WO | WO 2017/143042 A2 | 8/2017 |
| WO | WO 2017/147056 A1 | 8/2017 |
| WO | WO 2017/147278 A1 | 8/2017 |
| WO | WO 2017/147432 A1 | 8/2017 |
| WO | WO 2017/147446 A1 | 8/2017 |
| WO | WO 2017/147555 A1 | 8/2017 |
| WO | WO 2017/151444 A1 | 9/2017 |
| WO | WO 2017/151719 A1 | 9/2017 |
| WO | WO 2017/152015 A1 | 9/2017 |
| WO | WO 2017/155717 A1 | 9/2017 |
| WO | WO 2017/157422 A1 | 9/2017 |
| WO | WO 2017/158153 A1 | 9/2017 |
| WO | WO 2017/160689 A1 | 9/2017 |
| WO | WO 2017/160752 A1 | 9/2017 |
| WO | WO 2017/160890 A1 | 9/2017 |
| WO | WO 2017/161068 A1 | 9/2017 |
| WO | WO 2017/165826 A1 | 9/2017 |
| WO | WO 2017/165862 A1 | 9/2017 |
| WO | WO 2017/167712 A1 | 10/2017 |
| WO | WO 2017/172644 A2 | 10/2017 |
| WO | WO 2017/172645 A2 | 10/2017 |
| WO | WO 2017/172860 A1 | 10/2017 |
| WO | WO 2017/173004 A1 | 10/2017 |
| WO | WO 2017/173054 A1 | 10/2017 |
| WO | WO 2017/173092 A1 | 10/2017 |
| WO | WO 2017/174329 A1 | 10/2017 |
| WO | WO 2017/176529 A1 | 10/2017 |
| WO | WO 2017/176806 A1 | 10/2017 |
| WO | WO 2017/178590 A1 | 10/2017 |
| WO | WO 2017/180694 A1 | 10/2017 |
| WO | WO 2017/180711 A1 | 10/2017 |
| WO | WO 2017/180915 A2 | 10/2017 |
| WO | WO 2017/180926 A1 | 10/2017 |
| WO | WO 2017/181107 A2 | 10/2017 |
| WO | WO 2017/181735 A2 | 10/2017 |
| WO | WO 2017/182468 A1 | 10/2017 |
| WO | WO 2017/184334 A1 | 10/2017 |
| WO | WO 2017/184768 A1 | 10/2017 |
| WO | WO 2017/184786 A1 | 10/2017 |
| WO | WO 2017/186550 A1 | 11/2017 |
| WO | WO 2017/189308 A1 | 11/2017 |
| WO | WO 2017/189336 A1 | 11/2017 |
| WO | WO 2017/190041 A1 | 11/2017 |
| WO | WO 2017/190257 A1 | 11/2017 |
| WO | WO 2017/190664 A1 | 11/2017 |
| WO | WO 2017/191210 A1 | 11/2017 |
| WO | WO 2017/191274 A2 | 11/2017 |
| WO | WO 2017/192172 A1 | 11/2017 |
| WO | WO 2017/192512 A2 | 11/2017 |
| WO | WO 2017/192544 A1 | 11/2017 |
| WO | WO 2017/192573 A1 | 11/2017 |
| WO | WO 2017/193029 A2 | 11/2017 |
| WO | WO 2017/193053 A1 | 11/2017 |
| WO | WO 2017/196768 A1 | 11/2017 |
| WO | WO 2017/197038 A1 | 11/2017 |

(56) References Cited

FOREIGN PATENT DOCUMENTS

| | | |
|---|---|---|
| WO | WO 2017/197238 A1 | 11/2017 |
| WO | WO 2017/197301 A1 | 11/2017 |
| WO | WO 2017/201476 A1 | 11/2017 |
| WO | WO 2017/205290 A1 | 11/2017 |
| WO | WO 2017/205423 A1 | 11/2017 |
| WO | WO 2017/207589 A1 | 12/2017 |
| WO | WO 2017/208247 A1 | 12/2017 |
| WO | WO 2017/209809 A1 | 12/2017 |
| WO | WO 2017/213896 A1 | 12/2017 |
| WO | WO 2017/213898 A2 | 12/2017 |
| WO | WO 2017/214460 A1 | 12/2017 |
| WO | WO 2017/216392 A1 | 12/2017 |
| WO | WO 2017/216771 A2 | 12/2017 |
| WO | WO 2017/218185 A1 | 12/2017 |
| WO | WO 2017/219027 A1 | 12/2017 |
| WO | WO 2017/219033 A1 | 12/2017 |
| WO | WO 2017/220751 A1 | 12/2017 |
| WO | WO 2017/222370 A1 | 12/2017 |
| WO | WO 2017/222773 A1 | 12/2017 |
| WO | WO 2017/222834 A1 | 12/2017 |
| WO | WO 2017/223107 A1 | 12/2017 |
| WO | WO 2017/223330 A1 | 12/2017 |
| WO | WO 2018/000657 A1 | 1/2018 |
| WO | WO 2018/002719 A1 | 1/2018 |
| WO | WO 2018/005117 A1 | 1/2018 |
| WO | WO 2018/005289 A2 | 1/2018 |
| WO | WO 2018/005691 A1 | 1/2018 |
| WO | WO 2018/005782 A1 | 1/2018 |
| WO | WO 2018/005873 A1 | 1/2018 |
| WO | WO 2018/06693 A1 | 1/2018 |
| WO | WO 2018/009520 A1 | 1/2018 |
| WO | WO 2018/009562 A1 | 1/2018 |
| WO | WO 2018/009822 A1 | 1/2018 |
| WO | WO 2018/013821 A1 | 1/2018 |
| WO | WO 2018/013932 A1 | 1/2018 |
| WO | WO 2018/013990 A1 | 1/2018 |
| WO | WO 2018/014384 A1 | 1/2018 |
| WO | WO 2018/015444 A1 | 1/2018 |
| WO | WO 2018/015936 A2 | 1/2018 |
| WO | WO 2018/017754 A1 | 1/2018 |
| WO | WO 2018/018979 A1 | 2/2018 |
| WO | WO 2018/020248 A1 | 2/2018 |
| WO | WO 2018/021878 A1 | 2/2018 |
| WO | WO 2018/022480 A1 | 2/2018 |
| WO | WO 2018/022634 A1 | 2/2018 |
| WO | WO 2018/025206 A1 | 2/2018 |
| WO | WO 2018/026723 A1 | 2/2018 |
| WO | WO 2018/026976 A1 | 2/2018 |
| WO | WO 2018/027078 A1 | 2/2018 |
| WO | WO 2018/030608 A1 | 2/2018 |
| WO | WO 2018/031683 A1 | 2/2018 |
| WO | WO 2018/035250 A1 | 2/2018 |
| WO | WO 2018/035300 A1 | 2/2018 |
| WO | WO 2018/035423 A1 | 2/2018 |
| WO | WO 2018/035503 A1 | 2/2018 |
| WO | WO 2018/039145 A1 | 3/2018 |
| WO | WO 2018/039438 A1 | 3/2018 |
| WO | WO 2018/039440 A1 | 3/2018 |
| WO | WO 2018/039448 A1 | 3/2018 |
| WO | WO 2018/045630 A1 | 3/2018 |
| WO | WO 2018/048827 A1 | 3/2018 |
| WO | WO 2018/049073 A1 | 3/2018 |
| WO | WO 2018/049168 A1 | 3/2018 |
| WO | WO 2018/051347 A1 | 3/2018 |
| WO | WO 2018/058064 A1 | 3/2018 |
| WO | WO 2018/062866 A2 | 4/2018 |
| WO | WO 2018/064352 A1 | 4/2018 |
| WO | WO 2018/064371 A1 | 4/2018 |
| WO | WO 2018/064516 A1 | 4/2018 |
| WO | WO 2018/067546 A1 | 4/2018 |
| WO | WO 2018/067846 A1 | 4/2018 |
| WO | WO 2018/068053 A2 | 4/2018 |
| WO | WO 2018/069474 A1 | 4/2018 |
| WO | WO 2018/071623 A2 | 4/2018 |
| WO | WO 2018/071663 A1 | 4/2018 |
| WO | WO 2018/071868 A1 | 4/2018 |
| WO | WO 2018/071892 A1 | 4/2018 |
| WO | WO 2018/074979 A1 | 4/2018 |
| WO | WO 2018/079134 A1 | 5/2018 |
| WO | WO 2018/080573 A1 | 5/2018 |
| WO | WO 2018/081504 A1 | 5/2018 |
| WO | WO 2018/081535 A2 | 5/2018 |
| WO | WO 2018/081728 A1 | 5/2018 |
| WO | WO 2018/083128 A2 | 5/2018 |
| WO | WO 2018/083606 A1 | 5/2018 |
| WO | WO 2018/085288 A1 | 5/2018 |
| WO | WO 2018/085414 A1 | 5/2018 |
| WO | WO 2018/086623 A1 | 5/2018 |
| WO | WO 2018/089664 A1 | 5/2018 |
| WO | WO 2018/093990 A1 | 5/2018 |
| WO | WO 2018/098383 A1 | 5/2018 |
| WO | WO 2018/098480 A1 | 5/2018 |
| WO | WO 2018/098587 A1 | 6/2018 |
| WO | WO 2018/099256 A1 | 6/2018 |
| WO | WO 2018/103686 A1 | 6/2018 |
| WO | WO 2018/106268 A1 | 6/2018 |
| WO | WO 2018/107028 A1 | 6/2018 |
| WO | WO 2018/107103 A1 | 6/2018 |
| WO | WO 2018/107129 A1 | 6/2018 |
| WO | WO 2018/108272 A1 | 6/2018 |
| WO | WO 2018/109101 A1 | 6/2018 |
| WO | WO 2018/111946 A1 | 6/2018 |
| WO | WO 2018/111947 A1 | 6/2018 |
| WO | WO 2018/112336 A1 | 6/2018 |
| WO | WO 2018/112446 A2 | 6/2018 |
| WO | WO 2018/119354 A1 | 6/2018 |
| WO | WO 2018/119359 A1 | 6/2018 |
| WO | WO 2018/120283 A1 | 7/2018 |
| WO | WO 2018/130830 A1 | 7/2018 |
| WO | WO 2018/135838 A2 | 7/2018 |
| WO | WO 2018/136396 A2 | 7/2018 |
| WO | WO 2018/138385 A1 | 8/2018 |
| WO | WO 2018/142364 A1 | 8/2018 |
| WO | WO 2018/148246 A1 | 8/2018 |
| WO | WO 2018/148256 A1 | 8/2018 |
| WO | WO 2018/148647 A2 | 8/2018 |
| WO | WO 2018/149418 A1 | 8/2018 |
| WO | WO 2018/149888 A1 | 8/2018 |
| WO | WO 2018/149915 A1 | 8/2018 |
| WO | WO 2018/152197 A1 | 8/2018 |
| WO | WO 2018/152418 A1 | 8/2018 |
| WO | WO 2018/154380 A1 | 8/2018 |
| WO | WO 2018/154387 A1 | 8/2018 |
| WO | WO 2018/154412 A1 | 8/2018 |
| WO | WO 2018/154413 A1 | 8/2018 |
| WO | WO 2018/154418 A1 | 8/2018 |
| WO | WO 2018/154439 A1 | 8/2018 |
| WO | WO 2018/154459 A1 | 8/2018 |
| WO | WO 2018/154462 A2 | 8/2018 |
| WO | WO 2018/156372 A1 | 8/2018 |
| WO | WO 2018/156824 A1 | 8/2018 |
| WO | WO 2018/161009 A1 | 9/2018 |
| WO | WO 2018/165504 A1 | 9/2018 |
| WO | WO 2018/165629 A1 | 9/2018 |
| WO | WO 2018/170015 A1 | 9/2018 |
| WO | WO 2018/170340 A1 | 9/2018 |
| WO | WO 2018/175502 A2 | 9/2018 |
| WO | WO 2018/176009 A1 | 9/2018 |
| WO | WO 2018/177351 A1 | 10/2018 |
| WO | WO 2018/179578 A1 | 10/2018 |
| WO | WO 2018/183403 A1 | 10/2018 |
| WO | WO 2018/189184 A1 | 10/2018 |
| WO | WO 2018/191388 A1 | 10/2018 |
| WO | WO 2018/195402 A1 | 10/2018 |
| WO | WO 2018/195545 A2 | 10/2018 |
| WO | WO 2018/195555 A1 | 10/2018 |
| WO | WO 2018/197020 A1 | 11/2018 |
| WO | WO 2018/197495 A1 | 11/2018 |
| WO | WO 2018/202800 A1 | 11/2018 |
| WO | WO 2018/204493 A1 | 11/2018 |
| WO | WO 2018/208755 A1 | 11/2018 |
| WO | WO 2018/208998 A1 | 11/2018 |
| WO | WO 2018/209158 A2 | 11/2018 |
| WO | WO 2018/209320 A1 | 11/2018 |

(56) References Cited

FOREIGN PATENT DOCUMENTS

| | | |
|---|---|---|
| WO | WO 2018/213351 A1 | 11/2018 |
| WO | WO 2018/213708 A1 | 11/2018 |
| WO | WO 2018/213726 A1 | 11/2018 |
| WO | WO 2018/213771 A1 | 11/2018 |
| WO | WO 2018/213791 A1 | 11/2018 |
| WO | WO 2018/217852 A1 | 11/2018 |
| WO | WO 2018/217981 A1 | 11/2018 |
| WO | WO 2018/218166 A1 | 11/2018 |
| WO | WO 2018/218188 A2 | 11/2018 |
| WO | WO 2018/218206 A1 | 11/2018 |
| WO | WO 2018/226855 A1 | 12/2018 |
| WO | WO 2019/005884 A1 | 1/2019 |
| WO | WO 2019/005886 A1 | 1/2019 |
| WO | WO 2019/010384 A1 | 1/2019 |
| WO | WO 2019/023680 A1 | 1/2019 |
| WO | WO 2019/051097 A1 | 3/2019 |
| WO | WO 2019/075357 A1 | 4/2019 |
| WO | WO 2019/079347 A1 | 4/2019 |
| WO | WO 2019/084062 A1 | 5/2019 |
| WO | WO 2019/090367 A1 | 5/2019 |
| WO | WO 2019/092042 A1 | 5/2019 |
| WO | WO 2019/118935 A1 | 6/2019 |
| WO | WO 2019/118949 A1 | 6/2019 |
| WO | WO 2019/123430 A1 | 6/2019 |
| WO | WO 2019/139645 A2 | 7/2019 |
| WO | WO 2019/139951 A1 | 7/2019 |
| WO | WO 2019/147014 A1 | 8/2019 |
| WO | WO 2019/161251 A1 | 8/2019 |
| WO | WO 2019/168953 A1 | 9/2019 |
| WO | WO 2019/226953 A1 | 11/2019 |
| WO | WO 2019/241649 A1 | 12/2019 |
| WO | WO 2020/014261 A1 | 1/2020 |
| WO | WO 2020/028555 A2 | 2/2020 |
| WO | WO 2020/041751 A1 | 2/2020 |
| WO | WO 2020/047124 A1 | 3/2020 |
| WO | WO 2020/051360 A1 | 3/2020 |
| WO | WO 2020/086908 A1 | 4/2020 |
| WO | WO 2020/092453 A1 | 5/2020 |
| WO | WO 2020/102659 A1 | 5/2020 |
| WO | WO 2020/154500 A1 | 7/2020 |
| WO | WO 2020/180975 A1 | 9/2020 |
| WO | WO 2020/181178 A1 | 9/2020 |
| WO | WO 2020/181180 A1 | 9/2020 |
| WO | WO 2020/181193 A1 | 9/2020 |
| WO | WO 2020/181195 A1 | 9/2020 |
| WO | WO 2020/181202 A1 | 9/2020 |
| WO | WO 2020/191153 A1 | 9/2020 |
| WO | WO 2020/191153 A2 | 9/2020 |
| WO | WO 2020/191171 A1 | 9/2020 |
| WO | WO 2020/191233 A1 | 9/2020 |
| WO | WO 2020/191234 A1 | 9/2020 |
| WO | WO 2020/191239 A1 | 9/2020 |
| WO | WO 2020/191241 A1 | 9/2020 |
| WO | WO 2020/191242 A1 | 9/2020 |
| WO | WO 2020/191243 A1 | 9/2020 |
| WO | WO 2020/191245 A1 | 9/2020 |
| WO | WO 2020/191246 A1 | 9/2020 |
| WO | WO 2020/191248 A1 | 9/2020 |
| WO | WO 2020/191249 A1 | 9/2020 |
| WO | WO 2020/210751 A1 | 10/2020 |
| WO | WO 2020/214842 A1 | 10/2020 |
| WO | WO 2020/236982 A1 | 11/2020 |
| WO | WO 2021/025750 A1 | 2/2021 |
| WO | WO 2021/030666 A1 | 2/2021 |
| WO | WO 2021/072328 A1 | 4/2021 |
| WO | WO 2021/108717 A2 | 6/2021 |
| WO | WO 2021/138469 A1 | 7/2021 |
| WO | WO 2021/155065 A1 | 8/2021 |
| WO | WO 2021/158921 A2 | 8/2021 |
| WO | WO 2021/158995 A1 | 8/2021 |
| WO | WO 2021/158999 A1 | 8/2021 |
| WO | WO 2021/222318 A1 | 11/2021 |
| WO | WO 2021/226558 A1 | 11/2021 |

OTHER PUBLICATIONS

U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/836,080, filed Jun. 17, 2013, Zhang et al.
U.S. Appl. No. 61/837,481, filed Jun. 20, 2013, Cho et al.
U.S. Appl. No. 61/838,178, filed Jun. 21, 2013, Joung et al.
U.S. Appl. No. 61/874,682, filed Sep. 6, 2013, Liu et al.
U.S. Appl. No. 61/874,746, filed Sep. 6, 2013, Liu et al.
U.S. Appl. No. 62/288,661, filed Jan. 29, 2016, Muir et al.
U.S. Appl. No. 62/357,332, filed Jun. 30, 2016, Liu et al.
U.S. Appl. No. 62/498,686.
Extended European Search Report for EP 15830407.1, dated Mar. 2, 2018.
Extended European Search Report for EP 19181479.7, dated Oct. 31, 2019.
Extended European Search Report for EP18199195.1, dated Feb. 12, 2019.
International Preliminary Report on Patentability for PCT/US2014/048390, dated Mar. 7, 2019.
International Preliminary Report on Patentability for PCT/US2016/058344, dated May 3, 2018.
International Preliminary Report on Patentability for PCT/US2017/045381, dated Feb. 14, 2019.
International Preliminary Report on Patentability for PCT/US2017/046144, dated Feb. 21, 2019.
International Preliminary Report on Patentability for PCT/US2017/056671, dated Apr. 25, 2019.
International Preliminary Report on Patentability for PCT/US2017/068105, dated Jul. 4, 2019.
International Preliminary Report on Patentability for PCT/US2017/068114, dated Jul. 4, 2019.
International Preliminary Report on Patentability for PCT/US2012/047778, dated Feb. 6, 2014.
International Preliminary Report on Patentability for PCT/US2014/050283, dated Feb. 18, 2016.
International Preliminary Report on Patentability for PCT/US2014/052231, dated Mar. 3, 2016.
International Preliminary Report on Patentability for PCT/US2014/054247, dated Mar. 17, 2016.
International Preliminary Report on Patentability for PCT/US2014/054291, dated Mar. 17, 2016.
International Preliminary Report on Patentability for PCT/US2014/070038, dated Jun. 23, 2016.
International Preliminary Report on Patentability for PCT/US2015/042770, dated Dec. 19, 2016.
International Preliminary Report on Patentability for PCT/US2015/058479, dated May 11, 2017.
International Preliminary Report on Patentability for PCT/US2018/021664, dated Sep. 19, 2019.
International Preliminary Report on Patentability for PCT/US2018/021878, dated Sep. 19, 2019.
International Preliminary Report on Patentability for PCT/US2018/021880, dated Sep. 19, 2019.
International Preliminary Report on Patentability for PCT/US2018/024208, dated Oct. 3, 2019.
International Preliminary Report on Patentability for PCT/US2018/032460, dated Nov. 21, 2019.
International Preliminary Report on Patentability or PCT/US2014/054252, dated Mar. 17, 2016.
International Search Report and Written Opinion for PCT/US2012/047778, dated May 30, 2013.
International Search Report and Written Opinion for PCT/US2014/050283, dated Nov. 6, 2014.
International Search Report and Written Opinion for PCT/US2014/052231, dated Dec. 4, 2014.
International Search Report and Written Opinion for PCT/US2014/052231, dated Jan. 30, 2015 (Corrected Version).

(56) References Cited

OTHER PUBLICATIONS

International Search Report and Written Opinion for PCT/US2014/054247, dated Mar. 27, 2015.
International Search Report and Written Opinion for PCT/US2014/054252, dated Mar. 5, 2015.
International Search Report and Written Opinion for PCT/US2014/054291, dated Mar. 27, 2015.
International Search Report and Written Opinion for PCT/US2014/070038, dated Apr. 14, 2015.
International Search Report and Written Opinion for PCT/US2015/042770, dated Feb. 23, 2016.
International Search Report and Written Opinion for PCT/US2015/058479, dated Feb. 11, 2016.
International Search Report and Written Opinion for PCT/US2016/044546, dated Dec. 28, 2016.
International Search Report and Written Opinion for PCT/US2016/058344, dated Apr. 20, 2017.
International Search Report and Written Opinion for PCT/US2017/045381, dated Oct. 26, 2017.
International Search Report and Written Opinion for PCT/US2017/046144, dated Oct. 10, 2017.
International Search Report and Written Opinion for PCT/US2017/056671, dated Feb. 20, 2018.
International Search Report and Written Opinion for PCT/US2017/068105, dated Apr. 4, 2018.
International Search Report and Written Opinion for PCT/US2017/068114, dated Mar. 20, 2018.
International Search Report and Written Opinion for PCT/US2017/48390, dated Jan. 9, 2018.
International Search Report for PCT/US2013/032589, dated Jul. 26, 2013.
International Search Report for PCT/US2018/021664, dated Jun. 21, 2018.
International Search Report for PCT/US2018/021878, dated Aug. 20, 2018.
International Search Report for PCT/US2018/021880, dated Jun. 20, 2018.
International Search Report for PCT/US2018/024208, dated Aug. 23, 2018.
International Search Report for PCT/US2018/025887, dated Jun. 21, 2018.
International Search Report for PCT/US2018/032460, dated Jul. 11, 2018.
International Search Report for PCT/US2018/048969, dated Jul. 31, 2019.
Invitation to Pay Additional Fees for PCT/US2014/054291, dated Dec. 18, 2014.
Invitation to Pay Additional Fees for PCT/US2016/058344, dated Mar. 1, 2017.
Invitation to Pay Additional Fees for PCT/US2017/056671, dated Dec. 21, 2017.
Invitation to Pay Additional Fees for PCT/US2017/48390, dated Nov. 7, 2017.
Invitation to Pay Additional Fees for PCT/US2018/021878, dated Jun. 8, 2018.
Partial European Search Report for Application No. EP 19187331.4, dated Dec. 19, 2019.
Partial Supplementary European Search Report for Application No. EP 12845790.0, dated Mar. 18, 2015.
Search Report and Written Opinion for SG 11201900907Y, dated Jul. 20, 2020.
Supplementary European Search Report for Application No. EP 12845790.0, dated Oct. 12, 2015.
[No Author Listed] "Human genome." Encyclopedia Britannica. Encyclopedia Britannica, Inc. Published Feb. 15, 2019. Last accessed online via https://www.britannica.com/science/human-genome on Mar. 19, 2021. 2 pages.
[No Author Listed] "Nucleic Acids Sizes and Molecular Weights." Printed Mar. 19, 2021. 2 pages.
[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.
[No Author Listed] Beast2: Bayesian evolutionary analysis by sampling trees. http://www.beast2.org/ Last accessed Apr. 28, 2021.
[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Accession No. XP_015843220.1. C ->U editing enzyme APOBEC-1 [Peromyscus maniculatus bairdii], XP002793540. Mar. 21, 2016.
[No Author Listed] NCBI Accession No. XP_021505673.1. C ->U editing enzyme APOBEC-1 [Meriones unguiculatus], XP002793541. Jun. 27, 2017.
[No Author Listed] Score result for SEQ 355 to WO2017032580. Muir et al. 2016.
[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.
[No Author Listed], "FokI" from New England Biolabs Inc. Last accessed online via https://www.neb.com/products/r0109-foki#Product%20Information on Mar. 19, 2021. 1 page.
[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed], "Lambda DNA" from Catalog & Technical Reference. New England Biolabs Inc. 2002/2003. pp. 133 and 270-273.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.
[No Author Listed], *Mus musculus* (Mouse). UniProtKB Accession No. P51908 (ABEC1_MOUSE). Oct. 1, 1996. 10 pages.
[No Author Listed], MutL homolog 1. UniProtKB Acc. No. F1MPG0. May 3, 2011. Accessible at https://rest.uniprot.org/unisave/F1MPG0?format=txt&versions=1. 1 page.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., C2c2 is a single-component programmable RNA-guided RNA-targeting CRISPR effector. Science. Aug. 5, 2016;353(6299):aaf5573. doi: 10.1126/science.aaf5573. Epub Jun. 2, 2016.
Abudayyeh et al., RNA targeting with CRISPR-Cas13. Nature. Oct. 12, 2017;550(7675):280-284. doi: 10.1038/nature24049. Epub Oct. 4, 2017.
Acharya et al., hMSH2 forms specific mispair-binding complexes with hMSH3 and hMSH6. Proc Natl Acad Sci U S A. Nov. 26, 1996;93(24):13629-34. doi: 10.1073/pnas.93.24.13629.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.

(56) References Cited

OTHER PUBLICATIONS

Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Adrian et al., Targeted SAINT-O-Somes for improved intracellular delivery of siRNA and cytotoxic drugs into endothelial cells. J Control Release. Jun. 15, 2010;144(3):341-9. doi: 10.1016/j.jconrel.2010.03.003. Epub Mar. 11, 2010.
Aguilera et al., Systemic in vivo distribution of activatable cell penetrating peptides is superior to that of cell penetrating peptides. Integr Biol (Camb). Jun. 2009;1(5-6):371-81. doi: 10.1039/b904878b. Epub May 11, 2009.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.
Aihara et al., A conformational switch controls the DNA cleavage activity of lambda integrase. Mol Cell. Jul. 2003;12(1):187-98.
Aik et al., Structure of human RNA $N^6$-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akinc et al., A combinatorial library of lipid-like materials for delivery of RNAi therapeutics. Nat Biotechnol. May 2008;26(5):561-9. doi: 10.1038/nbt1402. Epub Apr. 27, 2008.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Akopian et al., Chimeric recombinases with designed DNA sequence recognition. Proc Natl Acad Sci U S A. Jul. 22, 2003;100(15):8688-91. Epub Jul. 1, 2003.
Al-Taei et al., Intracellular traffic and fate of protein transduction domains HIV-1 TAT peptide and octaarginine. Implications for their utilization as drug delivery vectors. Bioconjug Chem. Jan.-Feb. 2006;17(1):90-100.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.

Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Allen et al., Liposomal drug delivery systems: from concept to clinical applications. Adv Drug Deliv Rev. Jan. 2013;65(1):36-48. doi: 10.1016/j.addr.2012.09.037. Epub Oct. 1, 2012.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known γ-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014: 546:1-20.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anderson, Human gene therapy. Science. May 8, 1992;256(5058):808-13. doi: 10.1126/science.1589762.
André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSR1. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.
Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.

(56) References Cited

OTHER PUBLICATIONS

Arnold et al., Mutants of Tn3 resolvase which do not require accessory binding sites for recombination activity. EMBO J. Mar. 1, 1999;18(5):1407-14.

Asante et al., A naturally occurring variant of the human prion protein completely prevents prion disease. Nature. Jun. 25, 2015;522(7557):478-81. doi: 10.1038/nature14510. Epub Jun. 10, 2015.

Asokan et al., The AAV vector toolkit: poised at the clinical crossroads. Mol Ther. Apr. 2012;20(4):699-708. doi: 10.1038/mt.2011.287. Epub Jan. 24, 2012.

Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.

Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.

Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.

Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.

Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.

Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.

Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.

Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 2016.
Badran et al., Development of potent in vivo mutagenesis plasmids with broad mutational spectra. Nat Commun. Oct. 7, 2015;6:8425. doi: 10.1038/ncomms9425.
Badran et al., In vivo continuous directed evolution. Curr Opin Chem Biol. Feb. 2015;24:1-10. doi: 10.1016/j.cbpa.2014.09.040. Epub Nov. 7, 2014.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bae et al., Microhomology-based choice of Cas9 nuclease target sites. Nat Methods. Jul. 2014;11(7):705-6. doi: 10.1038/nmeth.3015.
Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi:10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barmania et al., C-C chemokine receptor type five (CCR5): An emerging target for the control of HIV infection. Appl Transl Genom. May 26, 2013;2:3-16. doi: 10.1016/j.atg.2013.05.004.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an N-terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone.0188593.
Bass, B.L., RNA editing by adenosine deaminases that act on RNA. Annu Rev Biochem. 2002;71:817-46. doi: 10.1146/annurev.biochem.71.110601.135501. Epub Nov. 9, 2001.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Beaudry et al., Directed evolution of an RNA enzyme. Science. Jul. 31, 1992;257(5070):635-41. doi: 10.1126/science.1496376.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.
Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.

(56) References Cited

OTHER PUBLICATIONS

Behr, Gene transfer with synthetic cationic amphiphiles: prospects for gene therapy. Bioconjug Chem. Sep.-Oct. 1994;5(5):382-9. doi: 10.1021/bc00029a002.
Bell et al., Ribozyme-catalyzed excision of targeted sequences from within RNAs. Biochemistry. Dec. 24, 2002;41(51):15327-33. doi: 10.1021/bi0267386.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Benarroch, HCN channels: function and clinical implications. Neurology. Jan. 15, 2013;80(3):304-10. doi: 10.1212/WNL.0b013e31827dec42.
Bennett et al., Painful and painless channelopathies. Lancet Neurol. Jun. 2014;13(6):587-99. doi: 10.1016/S1474-4422(14)70024-9. Epub May 6, 2014.
Bentin, T., A ribozyme transcribed by a ribozyme. Artif DNA PNA XNA. Apr. 2011;2(2):40-42. doi: 10.4161/adna.2.2.16852.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375. 1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008. 01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex Vivo in Vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASH1 mRNA particles in living yeast. Mol Cell. Oct. 1998;2(4):437-45. doi: 10.1016/s1097-2765(00)80143-4.
Bertsimas et al., Simulated annealing. Statistical Science. Feb. 1993;8(1):10-15. doi: 10.1214/ss/1177011077.
Bessen et al., High-resolution specificity profiling and off-target prediction for site-specific DNA recombinases. Nat Commun. Apr. 26, 2019;10(1):1937. doi: 10.1038/s41467-019-09987-0.
Beumer et al., Efficient gene targeting in *Drosophila* with zinc-finger nucleases. Genetics. Apr. 2006;172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.

Bibikova et al., Stimulation of homologous recombination through targeted cleavage by chimeric nucleases. Mol Cell Biol. Jan. 2001;21(1):289-97.
Bibikova et al., Targeted chromosomal cleavage and mutagenesis in *Drosophila* using zinc-finger nucleases. Genetics. Jul. 2002;161(3):1169-75.
Bibikova et al., Targeted chromosomal cleavage and mutagenesis in *Drosophila* using zinc-finger nucleases. Genetics. Jul. 2002;161(3):1169-75. doi: 10.1093/genetics/161.3.1169.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel. 2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast *Torulaspora delbrueckii*. Plasmid. 1997;38(3):202-9. doi: 10.1006/plas.1997. 1315.
Blau et al., A proliferation switch for genetically modified cells. PNAS Apr. 1, 1997 94 (7) 3076-3081; https://doi.org/10.1073/pnas. 94.7.3076.
Blauw et al., SMN1 gene duplications are associated with sporadic ALS. Neurology. Mar. 13, 2012;78(11):776-80. doi: 10.1212/WNL. 0b013e318249f697. Epub Feb. 8, 2012.
Bloom et al., Evolving strategies for enzyme engineering. Curr Opin Struct Biol. Aug. 2005;15(4):447-52.
Boch et al., Breaking the code of DNA binding specificity of TAL-type III effectors. Science. Dec. 11, 2009;326(5959):1509-12. Doi: 10.1126/science.1178811.
Boch, TALEs of genome targeting. Nat Biotechnol. Feb. 2011;29(2):135-6. Doi: 10.1038/nbt.1767.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal. pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.

(56) References Cited

OTHER PUBLICATIONS

Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p5. http://cen.acs.org/articles/94/i17/Improved-route-single-base-genome.html.
Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611860310001634667.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Brierley et al., Viral RNA pseudoknots: versatile motifs in gene expression and replication. Nat Rev Microbiol. Aug. 2007;5(8):598-610. doi: 10.1038/nrmicro1704.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brutlag et al., Improved sensitivity of biological sequence database searches. Comput Appl Biosci. Jul. 1990;6(3):237-45. doi: 10.1093/bioinformatics/6.3.237.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Buckley et al., Targeting the von Hippel-Lindau E3 ubiquitin ligase using small molecules to disrupt the VHL/HIF-1α interaction. J Am Chem Soc. Mar. 14, 2012;134(10):4465-8. doi: 10.1021/ja209924v. Epub Feb. 27, 2012.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013;1010:3-17. doi: 10.1007/978-1-62703-411-1_1.
Bulow et al., Multienzyme systems obtained by gene fusion. Trends Biotechnol. Jul. 1991;9(7):226-31.
Bulyk et al., Exploring the DNA-binding specificities of zinc fingers with DNA microarrays. Proc Natl Acad Sci U S A. Jun. 19, 2001;98(13):7158-63. Epub Jun. 12, 2001.
Burke et al., Activating mutations of Tn3 resolvase marking interfaces important in recombination catalysis and its regulation. Mol Microbiol. Feb. 2004;51(4):937-48.
Burke et al., RNA Aptamers to the Adenosine Moiety of S-adenosyl Methionine: Structural Inferences From Variations on a Theme and the Reproducibility of Selex. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Burton et al., Gene delivery using herpes simplex virus vectors. DNA Cell Biol. Dec. 2002;21(12):915-36. doi: 10.1089/104454902762053864.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Buskirk et al., In vivo evolution of an RNA-based transcriptional activator. Chem Biol. Jun. 2003;10(6):533-40. doi: 10.1016/s1074-5521(03)00109-1.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Böck et al., Selenocysteine: the 21st amino acid. Mol Microbiol. Mar. 1991;5(3):515-20.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Caldecott et al., Single-strand break repair and genetic disease. Nat Rev Genet. Aug. 2008;9(8):619-31. doi: 10.1038/nrg2380.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.

(56) References Cited

OTHER PUBLICATIONS

Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.

Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.

Canver et al., Customizing the genome as therapy for the β-hemoglobinopathies. Blood. May 26, 2016;127(21):2536-45. doi: 10.1182/blood-2016-01-678128. Epub Apr. 6, 2016.

Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.

Cargill et al., Characterization of single-nucleotide polymorphisms in coding regions of human genes. Nat Genet. Jul. 1999;22(3):231-8.

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.

Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.

Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.

Caron et al., Intracellular delivery of a Tat-eGFP fusion protein into muscle cells. Mol Ther. Mar. 2001;3(3):310-8.

Carr et al., Genome engineering. Nat Biotechnol. Dec. 2009;27(12):1151-62. doi: 10.1038/nbt.1590.

Carroll et al., Gene targeting in *Drosophila* and Caenorhabditis elegans with zinc-finger nucleases. Methods Mol Biol. 2008;435:63-77. doi: 10.1007/978-1-59745-232-8_5.

Carroll et al., Progress and prospects: zinc-finger nucleases as gene therapy agents. Gene Ther. Nov. 2008;15(22):1463-8. doi: 10.1038/gt.2008.145. Epub Sep. 11, 2008.

Carroll, A CRISPR approach to gene targeting. Mol Ther. Sep. 2012;20(9):1658-60. doi: 10.1038/mt.2012.171.

Carroll, Genome engineering with zinc-finger nucleases. Genetics. Aug. 2011;188(4):773-82. doi: 10.1534/genetics.111.131433. Review.

Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.

Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.

Caspi et al., Distribution of split DnaE inteins in cyanobacteria. Mol Microbiol. Dec. 2003;50(5):1569-77. doi: 10.1046/j.1365-2958.2003.03825.x.

Cattaneo et al., SEL1L affects human pancreatic cancer cell cycle and invasiveness through modulation of PTEN and genes related to cell-matrix interactions. Neoplasia. 2005;7(11):1030-1038.

Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.

Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.

Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.

Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.

Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.

Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.

Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.

Chan et al., Molecular recording of mammalian embryogenesis. Nature. Jun. 2019;570(7759):77-82. doi: 10.1038/s41586-019-1184-5. Epub May 13, 2019.

Chan et al., Novel selection methods for DNA-encoded chemical libraries. Curr Opin Chem Biol. 2015;26:55-61. doi:10.1016/j.cbpa.2015.02.010.

Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.

Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.

Chang et al., Modification of DNA ends can decrease end joining relative to homologous recombination in mammalian cells. Proc Natl Acad Sci U S A. Jul. 1987;84(14):4959-63.

Chapman et al., Playing the end game: DNA double-strand break repair pathway choice. Mol Cell. Aug. 24, 2012;47(4):497-510. doi: 10.1016/j.molcel.2012.07.029.

Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.

Charpentier et al., Biotechnology: Rewriting a genome. Nature. Mar. 7, 2013;495(7439):50-1. doi: 10.1038/495050a.

Chatterjee et al., Robust Genome Editing of Single-Base PAM Targets; with Engineered ScCas9 Variants. bioRxiv. doi: 10.1101/620351. Posted Apr. 26, 2019.

Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.

Chavez et al., Highly efficient Cas9-mediated transcriptional programming. Nat Methods. Apr. 2015;12(4):326-8. doi: 10.1038/nmeth.3312. Epub Mar. 2, 2015.

Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.

Chavez et al., Precise Cas9 targeting enables genomic mutation prevention. Jun. 14, 2016. doi:https://doi.org/10.1101/058974. [Preprint].

Chavez et al., Precise Cas9 targeting enables genomic mutation prevention. Proc Natl Acad Sci U S A. Apr. 3, 2018;115(14):3669-3673. doi: 10.1073/pnas.1718148115. Epub Mar. 19, 2018.

Chavez et al., Therapeutic applications of the ΦC31 integrase system. Curr Gene Ther. Oct. 2011;11(5):375-81. Review.

Chavez et al., Therapeutic applications of the PhiC31 integrase system. Curr Gene Ther. Oct. 2011;11(5):375-81. Review.

Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.

Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.

Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.

(56) References Cited

OTHER PUBLICATIONS

Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Alterations in PMS2, MSH2 and MLH1 expression in human prostate cancer. Int J Oncol. May 2003;22(5):1033-43.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Chen et al., Enhanced proofreading governs CRISPR-Cas9 targeting accuracy. Nature. Oct. 19, 2017;550(7676):407-410. doi: 10.1038/nature24268. Epub Sep. 20, 2017.
Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.
Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.
Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 2013.
Chesnoy et al., Structure and function of lipid-DNA complexes for gene delivery. Annu Rev Biophys Biomol Struct. 2000;29:27-47.
Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chichili et al., Linkers in the structural biology of protein-protein interactions. Protein Science. 2013;22:153-67.
Chin, Expanding and reprogramming the genetic code of cells and animals. Annu Rev Biochem. 2014;83:379-408. doi: 10.1146/annurev-biochem-060713-035737. Epub Feb. 10, 2014.
Chipev et al., A leucine—proline mutation in the H1 subdomain of keratin 1 causes epidermolytic hyperkeratosis. Cell. Sep. 4, 1992;70(5):821-8.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999;181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., N(6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
Choi et al., Translesion synthesis across abasic lesions by human B-family and Y-family DNA polymerases α, δ, η, ι, κ, and REV1. J Mol Biol. Nov. 19, 2010;404(1):34-44. doi: 10.1016/j.jmb.2010.09.015. Epub Oct. 1, 2010.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-SceI system of *Saccharomyces cerevisiae*. Mol Cell Biol. Apr. 1995;15(4):1968-73. doi: 10.1128/MCB.15.4.1968.
Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.

(56) References Cited

OTHER PUBLICATIONS

Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cobb et al., Directed evolution: an evolving and enabling synthetic biology tool. Curr Opin Chem Biol. Aug. 2012;16(3-4):285-91. doi:10.1016/j.cbpa.2012.05.186. Epub Jun. 4, 2012. Review.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Cole-Strauss et al., Correction of the mutation responsible for sickle cell anemia by an RNA-DNA oligonucleotide. Science. Sep. 6, 1996;273(5280):1386-9.
Colletier et al., Protein encapsulation in liposomes: efficiency depends on interactions between protein and phospholipid bilayer. BMC Biotechnol. May 10, 2002;2:9.
Collinge, Prion diseases of humans and animals: their causes and molecular basis. Annu Rev Neurosci. 2001;24:519-50. doi: 10.1146/annurev.neuro.24.1.519.
Cong et al., Comprehensive interrogation of natural TALE DNA-binding modules and transcriptional repressor domains. Nat Commun. Jul. 24, 2012;3:968. doi: 10.1038/ncomms1962.
Cong et al., Multiplex genome engineering using CRISPR/Cas systems. Science. Feb. 15, 2013;339(6121):819-23. doi: 10.1126/science.1231143. Epub Jan. 3, 2013.
Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/GB-2008-9-6-229. Epub Jun. 17, 2008.
Corcia et al., The importance of the SMN genes in the genetics of sporadic ALS. Amyotroph Lateral Scler. Oct.-Dec. 2009;10(5-6):436-40. doi: 10.3109/17482960902759162.
Cornu et al., DNA-binding specificity is a major determinant of the activity and toxicity of zinc-finger nucleases. Mol Ther. Feb. 2008;16(2):352-8. Epub Nov. 20, 2007.
Cornu et al., Refining strategies to translate genome editing to the clinic. Nat Med. Apr. 3, 2017;23(4):415-423. doi: 10.1038/nm.4313.
Corti et al., Genetic correction of human induced pluripotent stem cells from patients with spinal muscular atrophy. Sci Transl Med. Dec. 19, 2012;4(165):165ra162. doi: 10.1126/scitranslmed.3004108.
Costa et al., Frequent use of the same tertiary motif by self-folding RNAs. Embo J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI : 10.2174/1389450117011512171109017.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into mammalian cells in vitro and in vivo using a supercharged protein. ACS Chem Biol. Aug. 20, 2010;5(8):747-52. doi: 10.1021/cb1001153.
Crystal, Transfer of genes to humans: early lessons and obstacles to success. Science. Oct. 20, 1995;270(5235):404-10. doi: 10.1126/science.270.5235.404.
Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.

(56) References Cited

OTHER PUBLICATIONS

D'Adda di Fagagna et al., The Gam protein of bacteriophage Mu is an orthologue of eukaryotic Ku. EMBO Rep. Jan. 2003;4(1):47-52.

D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.

Dahlem et al., Simple methods for generating and detecting locus-specific mutations induced with TALENs in the zebrafish genome. PLoS Genet. 2012;8(8):e1002861. doi: 10.1371/journal.pgen. 1002861. Epub Aug. 16, 2012.

Dahlgren et al., A novel mutation in ribosomal protein S4 that affects the function of a mutated RF1. Biochimie. Aug. 2000;82(8):683-91.

Dahlman et al., Orthogonal gene knockout and activation with a catalytically active Cas9 nuclease. Nat Biotechnol. Nov. 2015;33(11):1159-61. doi: 10.1038/nbt.3390.

Dandage et al., beditor: A Computational Workflow for Designing Libraries of Guide RNAs for CRISPR-Mediated Base Editing. Genetics. Jun. 2019;212(2):377-385. doi: 10.1534/genetics.119. 302089. Epub Apr. 1, 2019.

Dang et al., Optimizing sgRNA structure to improve CRISPR-Cas9 knockout efficiency. Genome Biol. Dec. 15, 2015;16:280. doi: 10.1186/s13059-015-0846-3.

Das et al., The crystal structure of the monomeric reverse transcriptase from Moloney murine leukemia virus. Structure. May 2004;12(5):819-29. doi: 10.1016/j.str.2004.02.032.

Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.

Dassa et al., Trans protein splicing of cyanobacterial split inteins in endogenous and exogenous combinations. Biochemistry. Jan. 9, 2007;46(1):322-30. doi: 10.1021/bi0611762.

Database EBI Accession No. ADE34233 Jan. 29, 2004.

Database EBI Accession No. BFF09785. May 3, 20181. 2 pages.

Database EBI Accession No. BGE38086. Jul. 25, 2019. 2 pages.

Database UniProt Accession No. G813E0. Jan. 14, 2012.

Datsenko et al., One-step inactivation of chromosomal genes in *Escherichia coli* K-12 using PCR products. Proc Natl Acad Sci U S A. Jun. 6, 2000;97(12):6640-5.

Davidson et al., Viral vectors for gene delivery to the nervous system. Nat Rev Neurosci. May 2003;4(5):353-64. doi: 10.1038/nrn1104.

Davis et al., Assaying Repair at DNA Nicks. Methods Enzymol. 2018;601:71-89. doi: 10.1016/bs.mie.2017.12.001. Epub Feb. 1, 2018.

Davis et al., DNA double strand break repair via non-homologous end-joining. Transl Cancer Res. Jun. 2013;2(3):130-143.

Davis et al., Homology-directed repair of DNA nicks via pathways distinct from canonical double-strand break repair. Proc Natl Acad Sci U S A. Mar. 11, 2014;111(10):E924-32. doi: 10.1073/pnas. 1400236111. Epub Feb. 20, 2014.

Davis et al., Small molecule-triggered Cas9 protein with improved genome-editing specificity. Nat Chem Biol. May 2015;11(5):316-8. doi: 10.1038/nchembio.1793. Epub Apr. 6, 2015.

Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.

De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc. M211644200. Epub Jan. 8, 2003.

De La Peña et al., The Hammerhead Ribozyme: A Long History for a Short RNA. Molecules. Jan. 4, 2017;22(1):78. doi: 10.3390/molecules22010078.

De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.

De Souza, Primer: genome editing with engineered nucleases. Nat Methods. Jan. 2012;9(1):27.

De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.

Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.

Dekosky et al., Large-scale sequence and structural comparisons of human naive and antigen-experienced antibody repertoires. Proc Natl Acad Sci U S A. May 10, 2016;113(19):E2636-45. doi: 10.1073/pnas. 1525510113. Epub Apr. 25, 2016.

Delebecque et al., Organization of intracellular reactions with rationally designed RNA assemblies. Science. Jul. 22, 2011;333(6041):470-4. doi: 10.1126/science.1206938. Epub Jun. 23, 2011.

Deltcheva et al., CRISPR RNA maturation by trans-encoded small RNA and host factor RNase III. Nature. Mar. 31, 2011;471(7340):602-7. doi: 10.1038/nature09886.

Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.

Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.

Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.

Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.

Dever et al., CRISPR/Cas9 β-globin gene targeting in human haematopoietic stem cells. Nature. Nov. 17, 2016;539(7629):384-389. doi: 10.1038/nature20134. Epub Nov. 7, 2016.

Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.

Devigili et al., Paroxysmal itch caused by gain-of-function Nav1.7 mutation. Pain. Sep. 2014;155(9):1702-1707. doi: 10.1016/j.pain. 2014.05.006. Epub May 10, 2014.

Dianov et al., Mammalian base excision repair: the forgotten archangel. Nucleic Acids Res. Apr. 1, 2013;41(6):3483-90. doi: 10.1093/nar/gkt076. Epub Feb. 13, 2013.

Dicarlo et al., Genome engineering in *Saccharomyces cerevisiae* using CRISPR-Cas systems. Nucleic Acids Research Apr. 2013;41(7):4336-43.

Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.

Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.

Dickey et al., Single-stranded DNA-binding proteins: multiple domains for multiple functions. Structure. Jul. 2, 2013;21(7):1074-84. doi: 10.1016/j.str.2013.05.013.

Dickinson et al., A system for the continuous directed evolution of proteases rapidly reveals drug-resistance mutations. Nat Commun. Oct. 30, 2014;5:5352. doi: 10.1038/ncomms6352.

Dickinson et al., Experimental interrogation of the path dependence and stochasticity of protein evolution using phage-assisted continuous evolution. Proc Natl Acad Sci USA. May 2013;110(22):9007-12.

Dillon, Regulating gene expression in gene therapy. Trends Biotechnol. May 1993;11(5):167-73. doi: 10.1016/0167-7799(93)90109-M.

Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.

(56) References Cited

OTHER PUBLICATIONS

Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Dolan et al., Trans-splicing with the group I intron ribozyme from Azoarcus. RNA. Feb. 2014;20(2):202-13. doi: 10.1261/rna.041012.113. Epub Dec. 16, 2013.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dormiani et al., Long-term and efficient expression of human β-globin gene in a hematopoietic cell line using a new site-specific integrating non-viral system. Gene Ther. Aug. 2015;22(8):663-74. doi: 10.1038/gt.2015.30. Epub Apr. 1, 2015.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.
Doudna et al., Genome editing. The new frontier of genome engineering with CRISPR-Cas9. Science. Nov. 28, 2014;346(6213):1258096. doi: 10.1126/science.1258096.
Dove et al., Conversion of the omega subunit of Escherichia coli RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Enhancing zinc-finger-nuclease activity with improved obligate heterodimeric architectures. Nat Methods. Jan. 2011;8(1):74-9. Doi: 10.1038/nmeth.1539. Epub Dec. 5, 2010.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci U S A. Aug. 15, 1991;88(16):7160-4.
Drenth et al., Mutations in sodium-channel gene SCN9A cause a spectrum of human genetic pain disorders. J Clin Invest. Dec. 2007;117(12):3603-9. doi: 10.1172/JCI33297.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.

Dubois et al., Retroviral RNA Dimerization: From Structure to Functions. Front Microbiol. Mar. 22, 2018;9:527. doi: 10.3389/fmicb.2018.00527.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.theverge.com/2016/4/20/11450262/crispr-base-editing-single-nucleotides-dna-gene-liu-harvard.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Durai et al., A bacterial one-hybrid selection system for interrogating zinc finger-DNA interactions. Comb Chem High Throughput Screen. May 2006;9(4):301-11.
Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Edlund et al., Cell-specific expression of the rat insulin gene: evidence for role of two distinct 5' flanking elements. Science. Nov. 22, 1985;230(4728):912-6. doi: 10.1126/science.3904002.
Edwards et al., An Escherichia coli tyrosine transfer RNA is a leucine-specific transfer RNA in the yeast Saccharomyces cerevisiae. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Edwards et al., Structural basis for recognition of S-adenosylhomocysteine by riboswitches. RNA. Nov. 2010;16(11):2144-55. doi:10.1261/rna.2341610. Epub Sep. 23, 2010.
Eick et al., Robustness of Reconstructed Ancestral Protein Functions to Statistical Uncertainty. Mol Biol Evol. Feb. 1, 2017;34(2):247-261. doi: 10.1093/molbev/msw223.
Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Eisenberg et al., A-to-I RNA editing—immune protector and transcriptome diversifier. Nat Rev Genet. Aug. 2018; 19(8):473-490. doi: 10.1038/s41576-018-0006-1.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Ellington et al., In vitro selection of RNA molecules that bind specific ligands. Nature. Aug. 30, 1990;346(6287):818-22.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Emery et al., HCN2 ion channels play a central role in inflammatory and neuropathic pain. Science. Sep. 9, 2011;333(6048):1462-6. doi: 10.1126/science.1206243.
Endo et al., Toward establishing an efficient and versatile gene targeting system in higher plants. Biocatalysis and Agricultural Biotechnology 2014;3,(1):2-6.
Engel et al., The emerging role of mRNA methylation in normal and pathological behavior. Genes Brain Behav. Mar. 2018;17(3):e12428. doi: 10.1111/gbb.12428. Epub Nov. 17, 2017.
Engelward et al., Base excision repair deficient mice lacking the Aag alkyladenine DNA glycosylase. Proc Natl Acad Sci U S A. Nov. 25, 1997;94(24):13087-92.

(56) References Cited

OTHER PUBLICATIONS

England, Unnatural amino acid mutagenesis: a precise tool for probing; protein structure and function. Biochemistry. Sep. 21, 2004;43(37):11623-9.
Entin-Meer et al., The role of phenylalanine-119 of the reverse transcriptase of mouse mammary tumour virus in DNA synthesis, ribose selection and drug resistance. Biochem J. Oct. 15, 2002;367(Pt 2):381-91. doi: 10.1042/BJ20020712.
Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.
Epstein, HSV-1-based amplicon vectors: design and applications. Gene Ther. Oct. 2005;12 Suppl 1:S154-8. doi: 10.1038/sj.gt.3302617.
Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.
Estacion et al., A sodium channel gene SCN9A polymorphism that increases nociceptor excitability. Ann Neurol. Dec. 2009;66(6):862-6. doi: 10.1002/ana.21895.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.
Evans et al., Semisynthesis of cytotoxic proteins using a modified protein splicing element. Protein Sci. Nov. 1998;7(11):2256-64. doi: 10.1002/pro.5560071103.
Evans et al., The cyclization and polymerization of bacterially expressed proteins using modified self-splicing inteins. J Biol Chem. Jun. 25, 1999;274(26):18359-63. doi: 10.1074/jbc.274.26.18359.
Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.
Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.
Fagerlund et al., The Cpf1 CRISPR-Cas protein expands genome-editing tools. Genome Biology Nov. 17, 2015;16:251. https://doi.org/10.1186/s13059-015-0824-9.
Falnes et al., DNA repair by bacterial AlkB proteins. Res Microbiol. Oct. 2003;154(8):531-8. doi: 10.1016/S0923-2508(03)00150-5.
Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.
Fang et al., Human strand-specific mismatch repair occurs by a bidirectional mechanism similar to that of the bacterial reaction. J Biol Chem. Jun. 5, 1993;268(16):11838-44.
Fang et al., Synthetic Studies Towards Halichondrins: Synthesis of the Left Halves of Norhalichondrins and Homohalichondrins. Tetrahedron Letters 1992;33(12):1557-1560.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.
Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.
Farhood et al., Codelivery to mammalian cells of a transcriptional factor with cis-acting element using cationic liposomes. Anal Biochem. Feb. 10, 1995;225(1):89-93.
Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.
Feldstein et al., Two sequences participating in the autolytic processing of satellite tobacco ringspot virus complementary RNA. Gene. Oct. 15, 1989;82(1):53-61. doi: 10.1016/0378-1119(89)90029-2.
Felletti et al., Twister Ribozymes as Highly Versatile Expression Platforms for Artificial Riboswitches. Nat Commun. Sep. 27, 2016;7:12834. doi: 10.1038/ncomms12834.
Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.
Feng et al., Efficient genome editing in plants using a CRISPR/Cas system. Cell Res. Oct. 2013;23(10):1229-32. doi: 10.1038/cr.2013.114. Epub Aug. 20, 2013.
Feng et al., Human L1 retrotransposon encodes a conserved endonuclease required for retrotransposition. Cell. Nov. 29, 1996;87(5):905-16. doi: 10.1016/s0092-8674(00)81997-2.
Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.
Feuk, Inversion variants in the human genome: role in disease and genome architecture. Genome Med. Feb. 12, 2010;2(2):11. doi: 10.1186/gm132.
Filippov et al., A novel type of RNase III family proteins in eukaryotes. Gene. Mar. 7, 2000;245(1):213-21. doi: 10.1016/s0378-1119(99)00571-5.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fire et al., Potent and specific genetic interference by double-stranded RNA in Caenorhabditis elegans. Nature. Feb. 19, 1998;391(6669):806-11. doi: 10.1038/35888.
Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fishel et al., The human mutator gene homolog MSH2 and its association with hereditary nonpolyposis colon cancer. Cell. Dec. 3, 1993;75(5):1027-38. doi: 10.1016/0092-8674(93)90546-3. Erratum in: Cell. Apr. 8, 1994;77(1):1 p following 166.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in N-myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.

(56) References Cited

OTHER PUBLICATIONS

Fogg et al., Genome Integration and Excision by a New Streptomyces Bacteriophage, φJoe. Appl Environ Microbiol. Feb. 15, 2017;83(5):e02767-16. doi: 10.1128/AEM.02767-16.

Fogg et al., New applications for phage integrases. J Mol Biol. Jul. 29, 2014;426(15):2703-16. doi: 10.1016/j.jmb.2014.05.014. Epub May 22, 2014.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.

Forster et al., Self-cleavage of virusoid RNA is performed by the proposed 55-nucleotide active site. Cell. Jul. 3, 1987;50(1):9-16. doi: 10.1016/0092-8674(87)90657-x.

Fortini et al., Different DNA polymerases are involved in the short- and long-patch base excision repair in mammalian cells. Biochemistry. Mar. 17, 1998;37(11):3575-80. doi: 10.1021/bi972999h.

Fouts et al., Sequencing Bacillus anthracis typing phages gamma and cherry reveals a common ancestry. J Bacteriol. May 2006;188(9):3402-8. doi: 10.1128/JB.188.9.3402-3408.2006.

Freitas et al., Mechanisms and signals for the nuclear import of proteins. Curr Genomics. Dec. 2009;10(8):550-7. doi: 10.2174/138920209789503941.

Freshney, Culture of Animal Cells. A Manual of Basic Technique. Alan R. Liss, Inc. New York. 1983;4.

Friedman, J. H., Greedy function approximation: A gradient boosting machine. Ann. Statist. Oct. 2001;29(5):1189-232. doi: 10.1214/aos/1013203451.

Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.

Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.

Fu et al., Promises and Pitfalls of Intracellular Delivery of Proteins. Bioconjugate Chemistry. Aug. 2014;25:1602-8.

Fu et al., Targeted genome editing in human cells using CRISPR/Cas nucleases and truncated guide RNAs. Methods Enzymol. 2014;546:21-45. doi: 10.1016/B978-0-12-801185-0.00002-7.

Fuchs et al., Polyarginine as a multifunctional fusion tag. Protein Sci. Jun. 2005;14(6):1538-44.

Fujisawa et al., Disease-associated mutations in CIAS1 induce cathepsin B-dependent rapid cell death of human THP-1 monocytic cells. Blood. Apr. 1, 2007;109(7):2903-11.

Fukui et al., DNA Mismatch Repair in Eukaryotes and Bacteria. J Nucleic Acids. Jul. 27, 2010;2010. pii: 260512. doi: 10.4061/2010/260512.

Fung et al., Repair at single targeted DNA double-strand breaks in pluripotent and differentiated human cells. PLoS One. 2011;6(5):e20514. doi: 10.1371/journal.pone.0020514. Epub May 25, 2011.

Furukawa et al., In vitro selection of allosteric ribozymes that sense the bacterial second messenger c-di-GMP. Methods Mol Biol. 2014;1111:209-20. doi: 10.1007/978-1-62703-755-6_15.

Fusi et al., In Silico Predictive Modeling of CRISPR/Cas9 guide efficiency. Jun. 26, 2015; bioRxiv. http://dx.doi.org/10.1101/021568.

Gabriel et al., An unbiased genome-wide analysis of zinc-finger nuclease specificity. Nat Biotechnol. Aug. 7, 2011;29(9):816-23. doi: 10.1038/nbt.1948.

Gaj et al., 3rd. Genome engineering with custom recombinases. Methods Enzymol. 2014;546:79-91. doi: 10.1016/B978-0-12-801185-0.00004-0.

Gaj et al., A comprehensive approach to zinc-finger recombinase customization enables genomic targeting in human cells. Nucleic Acids Res. Feb. 6, 2013;41(6):3937-46.

Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.

Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.

Gaj et al., Structure-guided reprogramming of serine recombinase DNA sequence specificity. Proc Natl Acad Sci US A. Jan. 11, 2011;108(2):498-503. doi: 10.1073/pnas.1014214108. Epub Dec. 27, 2010.

Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.

Gajula, Designing an Elusive C•G→G•C CRISPR Base Editor. Trends Biochem Sci. Feb. 2019;44(2):91-94. doi: 10.1016/j.tibs.2018.10.004. Epub Nov. 13, 2018.

Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.

Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.

Gao et al., Cationic liposome-mediated gene transfer. Gene Ther. Dec. 1995;2(10):710-22.

Gao et al., Crystal structure of a TALE protein reveals an extended N-terminal DNA binding region. Cell Res. Dec. 2012;22(12):1716-20. doi: 10.1038/cr.2012.156. Epub Nov. 13, 2012.

Gao et al., DNA-guided genome editing using the Natronobacterium gregoryi Argonaute. Nat Biotechnol. Jul. 2016;34(7):768-73. doi: 10.1038/nbt.3547. Epub May 2, 2016.

Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.

Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.

Gapinske et al., CRISPR-SKIP: programmable gene splicing with single base editors. Genome Biol. Aug. 15, 2018;19(1):107. doi: 10.1186/s13059-018-1482-5.

Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.

Gardlik et al., Vectors and delivery systems in gene therapy. Med Sci Monit. Apr. 2005;11(4):RA110-21. Epub Mar. 24, 2005.

Garibyan et al., Use of the rpoB gene to determine the specificity of base substitution mutations on the *Escherichia coli* chromosome. DNA Repair (Amst). May 13, 2003;2(5):593-608.

Garneau et al., The CRISPR/Cas bacterial immune system cleaves bacteriophage and plasmid DNA. Nature. Nov. 4, 2010;468(7320):67-71. doi: 10.1038/nature09523.

Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.

Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.

Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.

Gaudelli et al., Programmable base editing of A•T to G•C in genomic DNA without DNA cleavage. Nature. Nov. 23, 2017;551(7681):464-471. doi: 10.1038/nature24644. Epub Oct. 25, 2017. Erratum in: Nature. May 2, 2018.

Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.

(56) References Cited

OTHER PUBLICATIONS

Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
GenBank Submission; NIH/NCBI Accession No. 4UN5_B. Anders et al., Jul. 23, 2014. 5 pages.
GenBank Submission; NIH/NCBI Accession No. NM_001319224. 2. Umar et al., Apr. 21, 2021. 7 pages.
GenBank Submission; NIH/NCBI Accession No. NM_006027.4. Umar et al., Apr. 10, 2021. 7 pages.
GenBank Submission; NIH/NCBI, Accession No. AAA66622.1. Martinelli et al., May 18, 1995. 2 pages.
GenBank Submission; NIH/NCBI, Accession No. AGT42196. Farzadfar et al., Nov. 2, 2013. 2 pages.
GenBank Submission; NIH/NCBI, Accession No. AIT42264.1. Hyun et al., Oct. 15, 2014. 2 pages.
GenBank Submission; NIH/NCBI, Accession No. AKA60242.1. Tong et al., Apr. 5, 2015. 1 page.
GenBank Submission; NIH/NCBI, Accession No. AKQ21048.1. Gilles et al., Jul. 19, 2015. 1 page.
GenBank Submission; NIH/NCBI, Accession No. AKS40380.1. Nodvig et al., Aug. 2, 2015. 1 page.
GenBank Submission; NIH/NCBI, Accession No. APG80656.1. Burstein et al., Dec. 10, 2016. 1 pages.
GenBank Submission; NIH/NCBI, Accession No. AYD60528.1. Ram et al., Oct. 2, 2018. 1 page.
GenBank Submission; NIH/NCBI, Accession No. BDB43378. Zhang et al., Aug. 11, 2016. 2 pages.
GenBank Submission; NIH/NCBI, Accession No. J04623. Kita et al., Apr. 26, 1993. 2 pages.
GenBank Submission; NIH/NCBI, Accession No. KR710351.1. Sahni et al., Jun. 1, 2015. 2 pages.
GenBank Submission; NIH/NCBI, Accession No. NC 002737.2. Nasser et al., Feb. 7, 2021. 2 pages.
GenBank Submission; NIH/NCBI, Accession No. NC_000001.11. Gregory et al., Jun. 6, 2016. 3 pages.
GenBank Submission; NIH/NCBI, Accession No. NC_002737.1. Ferretti et al., Jun. 27, 2013. 1 page.
GenBank Submission; NIH/NCBI, Accession No. NC_015683.1. Trost et al., Jul. 6, 2013. 1 page.
GenBank Submission; NIH/NCBI, Accession No. NC_016782.1. Trost et al., Jun. 11, 2013. 1 page.
GenBank Submission; NIH/NCBI, Accession No. NC_016786.1. Trost et al., Aug. 28, 2013. 1 page.
GenBank Submission; NIH/NCBI, Accession No. NC_017053.1. Fittipaldi et al., Jul. 6, 2013. 1 page.
GenBank Submission; NIH/NCBI, Accession No. NC_017317.1. Trost et al., Jun. 11, 2013. 1 page.
GenBank Submission; NIH/NCBI, Accession No. NC_017861.1. Heidelberg et al., Jun. 11, 2013. 1 page.
GenBank Submission; NIH/NCBI, Accession No. NC_018010.1. Lucas et al., Jun. 11, 2013. 2 pages.
GenBank Submission; NIH/NCBI, Accession No. NC_018721.1. Feng et al., Jun. 11, 2013. 1 pages.
GenBank Submission; NIH/NCBI, Accession No. NC_021284.1. Ku et al., Jul. 12, 2013. 1 page.
GenBank Submission; NIH/NCBI, Accession No. NC_021314.1. Zhang et al., Jul. 15, 2013. 1 page.
GenBank Submission; NIH/NCBI, Accession No. NC_021846.1. Lo et al., Jul. 22, 2013. 1 page.
GenBank Submission; NIH/NCBI, Accession No. NG_008692.2. McClintock et al., Aug. 27, 2018. 33 pages.
GenBank Submission; NIH/NCBI, Accession No. NM_000311.5. Alves et al., Mar. 7, 2021. 5 pages.
GenBank Submission; NIH/NCBI, Accession No. NM_001319224. Umar et al., Apr. 21, 2021. 7 pages.
GenBank Submission; NIH/NCBI, Accession No. NM_002945.3. Weiser et al., Sep. 3, 2017. 5 pages.
GenBank Submission; NIH/NCBI, Accession No. NM_002947.4. Xiao et al., May 1, 2019. 4 pages.
GenBank Submission; NIH/NCBI, Accession No. NM_003686. Umar et al., Apr. 9, 2021. 7 pages.
GenBank Submission; NIH/NCBI, Accession No. NM_003686.4. Umar et al., Apr. 9, 2021. 7 pages.
GenBank Submission; NIH/NCBI, Accession No. NM_006027. Umar et al., Apr. 10, 2021. 7 pages.
GenBank Submission; NIH/NCBI, Accession No. NM_174936. Guo et al., Oct. 28, 2015. 6 pages.
GenBank Submission; NIH/NCBI, Accession No. NM_206933.2. Khalaileh et al., Sep. 16, 2018. 12 pages.
GenBank Submission; NIH/NCBI, Accession No. NP_000302.1. Alves et al., Mar. 7, 2021. 4 pages.
GenBank Submission; NIH/NCBI, Accession No. NP_001075493. 1. Schiaffella et al., Jun. 24, 2018. 2 pages.
GenBank Submission; NIH/NCBI, Accession No. NP_001157741. 1. Zeng et al., Sep. 17, 2018. 3 pages.
GenBank Submission; NIH/NCBI, Accession No. NP_001157742. 1. Zeng et al., Oct. 21, 2018. 3 pages.
GenBank Submission; NIH/NCBI, Accession No. NP_033040.2. Liu et al., Jun. 23, 2018. 2 pages.
GenBank Submission; NIH/NCBI, Accession No. NP_358988.1. Hoskins et al., Jan. 11, 2017. 2 pages.
GenBank Submission; NIH/NCBI, Accession No. NP_472073.1. Glaser et al., Jun. 27, 2013. 2 pages.
GenBank Submission; NIH/NCBI, Accession No. NP_628093.1. Hsiao et al., Aug. 3, 2016. 2 pages.
GenBank Submission; NIH/NCBI, Accession No. NP_955579.1. Chen et al., Aug. 13, 2018. 5 pages.
GenBank Submission; NIH/NCBI, Accession No. P42212. Prasher et al., Mar. 19, 2014. 7 pages.
GenBank Submission; NIH/NCBI, Accession No. QBJ66766. Duan et al. Aug. 12, 2020. 2 pages.
GenBank Submission; NIH/NCBI, Accession No. RFF81513.1. Zhou et al., Aug. 21, 2018. 2 pages.
GenBank Submission; NIH/NCBI, Accession No. SNX31424.1. Weckx, S., Feb. 16, 2018. 2 pages.
GenBank Submission; NIH/NCBI, Accession No. TGH57013. Xu et al., Apr. 9, 2019. 2 pages.
GenBank Submission; NIH/NCBI, Accession No. WP_002989955. 1. No Author Listed, May 6, 2013. 1 page.
GenBank Submission; NIH/NCBI, Accession No. WP_010922251. 1. No Author Listed, May 15, 2013. 1 page.
GenBank Submission; NIH/NCBI, Accession No. WP_011054416. 1. No Author Listed, May 15, 2013. 1 page.
GenBank Submission; NIH/NCBI, Accession No. WP_011284745. 1. No Author Listed, May 16, 2013. 1 page.
GenBank Submission; NIH/NCBI, Accession No. WP_011285506. 1. No Author Listed, May 16, 2013. 1 page.
GenBank Submission; NIH/NCBI, Accession No. WP_011527619. 1. No Author Listed, May 16, 2013. 1 page.
GenBank Submission; NIH/NCBI, Accession No. WP_012560673. 1. No Author Listed, May 17, 2013. 1 page.
GenBank Submission; NIH/NCBI, Accession No. WP_014407541. 1. No Author Listed, May 18, 2013. 1 page.
GenBank Submission; NIH/NCBI, Accession No. WP_016631044. 1. Haft et al., Sep. 22, 2020. 1 page.
GenBank Submission; NIH/NCBI, Accession No. WP_020905136. 1. No Author Listed, Jul. 25, 2013. 1 page.
GenBank Submission; NIH/NCBI, Accession No. WP_023080005. 1. No Author Listed, Oct. 27, 2013. 1 page.
GenBank Submission; NIH/NCBI, Accession No. WP_023610282. 1. No Author Listed, Nov. 27, 2013. 1 page.
GenBank Submission; NIH/NCBI, Accession No. WP_030125963. 1. No Author Listed, Jul. 9, 2014. 1 page.

(56) References Cited

OTHER PUBLICATIONS

GenBank Submission; NIH/NCBI, Accession No. WP_030126706.1. No Author Listed, Jul. 9, 2014. 1 page.
GenBank Submission; NIH/NCBI, Accession No. WP_031386437. No Author Listed., Sep. 23, 2019. 1 page.
GenBank Submission; NIH/NCBI, Accession No. WP_031488318.1. No Author Listed., Aug. 5, 2014. 1 page.
GenBank Submission; NIH/NCBI, Accession No. WP_031589969.1. Haft et al., Oct. 9, 2019. 2 pages.
GenBank Submission; NIH/NCBI, Accession No. WP_032460140.1. No Author Listed, Oct. 4, 2014. 1 page.
GenBank Submission; NIH/NCBI, Accession No. WP_032461047.1. No Author Listed, Oct. 4, 2014. 1 page.
GenBank Submission; NIH/NCBI, Accession No. WP_032462016.1. Haft et al., Oct. 4, 2014. 1 page.
GenBank Submission; NIH/NCBI, Accession No. WP_032462936.1. No Author Listed, Oct. 4, 2014. 1 page.
GenBank Submission; NIH/NCBI, Accession No. WP_032464890.1. No Author Listed, Oct. 4, 2014. 1 page.
GenBank Submission; NIH/NCBI, Accession No. WP_038431314.1. No Author Listed, Dec. 26, 2014. 1 page.
GenBank Submission; NIH/NCBI, Accession No. WP_038432938.1. No Author Listed, Dec. 26, 2014. 1 page.
GenBank Submission; NIH/NCBI, Accession No. WP_038434062.1. No Author Listed, Dec. 26, 2014. 1 page.
GenBank Submission; NIH/NCBI, Accession No. WP_044924278.1. Haft et al., Oct. 9, 2019. 2 pages.
GenBank Submission; NIH/NCBI, Accession No. WP_047338501.1. Haft et al., Oct. 9, 2019. 2 pages.
GenBank Submission; NIH/NCBI, Accession No. WP_048327215.1. No Author Listed, Jun. 26, 2015. 1 page.
GenBank Submission; NIH/NCBI, Accession No. WP_049519324.1. No Author Listed, Jul. 20, 2015. 1 page.
GenBank Submission; NIH/NCBI, Accession No. WP_060798984.1. Haft et al., Oct. 9, 2019. 2 pages.
GenBank Submission; NIH/NCBI, Accession No. WP_062913273.1. Haft et al., Oct. 9, 2019, 2 pages.
GenBank Submission; NIH/NCBI, Accession No. WP_072754838. No Author Listed., Sep. 23, 2019. 1 page.
GenBank Submission; NIH/NCBI, Accession No. WP_095142515.1. No Author Listed., Sep. 23, 2019. 1 page.
GenBank Submission; NIH/NCBI, Accession No. WP_118538418.1. No Author Listed., Oct. 13, 2019. 1 page.
GenBank Submission; NIH/NCBI, Accession No. WP_119223642.1. No Author Listed., Oct. 13, 2019. 1 page.
GenBank Submission; NIH/NCBI, Accession No. WP_119227726.1. No Author Listed., Oct. 13, 2019. 1 page.
GenBank Submission; NIH/NCBI, Accession No. WP_119623382.1. No Author Listed., Oct. 13, 2019. 1 page.
GenBank Submission; NIH/NCBI, Accession No. WP_132221894.1. No Author Listed., Sep. 23, 2019. 1 page.
GenBank Submission; NIH/NCBI, Accession No. WP_133478044.1. Haft et al., Oct. 9, 2019. 2 pages.
GenBank Submission; NIH/NCBI, Accession No. XP_003314669.1. No Author Listed, Mar. 20, 2018. 2 pages.
GenBank Submission; NIH/NCBI, Accession No. XP_026671085.1. No Author Listed, Oct. 17, 2018. 1 page.
GenBank Submission; NIH/NCBI, Accession No. YP_002342100.1. Bernardini et al., Jun. 10, 2013. 2 pages.
GenBank Submission; NIH/NCBI, Accession No. YP_002344900.1. Gundogdu et al., Mar. 19, 2014. 2 pages.
GenBank Submission; NIH/NCBI, Accession No. YP_009137104.1. Davison, Aug. 13, 2018. 2 pages.
GenBank Submission; NIH/NCBI, Accession No. YP_009283008.1. Bernardini et al., Sep. 23, 2016. 2 pages.
GenBank Submission; NIH/NCBI, Accession No. YP_820832.1. Makarova et al., Aug. 27, 2013. 2 pages.
Geng et al., In vitro studies of DNA mismatch repair proteins. Anal Biochem. Jun. 15, 2011;413(2):179-84. doi: 10.1016/j.ab.2011.02.017. Epub Feb. 15, 2011.
Genschel et al., Human exonuclease I is required for 5' and 3' mismatch repair. J Biol Chem. Apr. 12, 2002;277(15):13302-11. doi: 10.1074/jbc.M111854200. Epub Jan. 24, 2002.
Genschel et al., Isolation of MutSbeta from human cells and comparison of the mismatch repair specificities of MutSbeta and MutSalpha. J Biol Chem. Jul. 31, 1998;273(31):19895-901. doi: 10.1074/jbc.273.31.19895. Erratum in: J Biol Chem Oct. 9, 1998;273(41):27034.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Glasgow et al., DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.

(56) References Cited

OTHER PUBLICATIONS

Goodnough et al., Development of a delivery vehicle for intracellular transport of botulinum neurotoxin antagonists. FEBS Lett. Feb. 27, 2002;513(2-3):163-8.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.
Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.
Gregory et al., Integration site for *Streptomyces* phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):REVIEWS1017. doi: 10.1186/GB-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004;166(4):1775-82. doi: 10.1534/genetics.166.4.1775.
Groth et al., Phage integrases: biology and applications. J Mol Biol. Jan. 16, 2004;335(3):667-78.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Grundy et al., The L box regulon: lysine sensing by leader RNAs of bacterial lysine biosynthesis genes. Proc Natl Acad Sci U S A. Oct. 14, 2003;100(21):12057-62. Epub Oct. 1, 2003.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guedon et al., Current gene therapy using viral vectors for chronic pain. Mol Pain. May 13, 2015;11:27. doi: 10.1186/s12990-015-0018-1.
Gueneau et al., Structure of the MutLα C-terminal domain reveals how Mlh1 contributes to Pms1 endonuclease site. Nat Struct Mol Biol. Apr. 2013;20(4):461-8. doi: 10.1038/nsmb.2511. Epub Feb. 24, 2013.
Guerrette et al., The interaction of the human MutL homologues in hereditary nonpolyposis colon cancer. J Biol Chem. Mar. 5, 1999;274(10):6336-41. doi: 10.1074/jbc.274.10.6336.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Directed evolution of an enhanced and highly efficient FokI cleavage domain for zinc finger nucleases. J Mol Biol. Jul. 2, 2010;400(1):96-107. doi: 10.1016/j.jmb.2010.04.060. Epub May 4, 2010.
Guo et al., Evolution of Tetrahymena ribozyme mutants with increased structural stability. Nat Struct Biol. Nov. 2002;9(11):855-61. doi: 10.1038/nsb850.
Guo et al., Facile functionalization of FK506 for biological studies by the thiol-ene 'click' reaction. RSC Advances. 2014;22:11400-3.
Guo et al., Protein tolerance to random amino acid change. Proc Natl Acad Sci U S A. Jun. 22, 2004;101(25):9205-10. Epub Jun. 14, 2004.
Guo et al., Structure of Cre recombinase complexed with DNA in a site-specific recombination synapse. Nature. Sep. 4, 1997;389(6646):40-6.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Mechanism of mismatch recognition revealed by human MutSβ bound to unpaired DNA loops. Nat Struct Mol Biol. Dec. 18, 2011;19(1):72-8. doi: 10.1038/nsmb.2175.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Gupta et al., Zinc finger protein-dependent and -independent contributions to the in vivo off-target activity of zinc finger nucleases. Nucleic Acids Res. Jan. 2011;39(1):381-92. doi: 10.1093/nar/gkq787. Epub Sep. 14, 2010.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Hagen et al., A high rate of polymerization during synthesis of mouse mammary tumor virus DNA alleviates hypermutation by APOBEC3 proteins. PLoS Pathog. Feb. 15, 2019;15(2):e1007533. doi: 10.1371/journal.ppat.1007533.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Hale et al., RNA-guided RNA cleavage by a CRISPR RNA-Cas protein complex. Cell. Nov. 25, 2009;139(5):945-56. doi: 10.1016/j.cell.2009.07.040.

(56) References Cited

OTHER PUBLICATIONS

Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibiol8/webprogram/paper544785.html. Retrieved Jun. 29, 2020.

Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.

Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.

Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.

Hampel et al., Evidence for preorganization of the glmS ribozyme ligand binding pocket. Biochemistry. 2006; 45(25):7861-71.

Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna.

Handa et al., Template-assisted synthesis of adenine-mutagenized cDNA by a retroelement protein complex. Nucleic Acids Res. Oct. 12, 2018;46(18):9711-9725. doi: 10.1093/nar/gky620.

Hanson et al., Codon optimality, bias and usage in translation and mRNA decay. Nat Rev Mol Cell Biol. Jan. 2018;19(1):20-30. doi: 10.1038/nrm.2017.91. Epub Oct. 11, 2017.

Hardt et al.,Missense variants in hMLH1 identified in patients from the German HNPCC consortium and functional studies. Fam Cancer. Jun. 2011;10(2):273-84. doi: 10.1007/s10689-011-9431-4.

Harms et al., Evolutionary biochemistry: revealing the historical and physical causes of protein properties. Nat Rev Genet. Aug. 2013;14(8):559-71. doi: 10.1038/nrg3540.

Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.

Harrington et al., A thermostable Cas9 with increased lifetime in human plasma. Nat Commun. Nov. 10, 2017;8(1):1424. doi: 10.1038/s41467-017-01408-4.

Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.

Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.

Harris et al., RNA Editing Enzyme APOBEC1 and Some of Its Homologs Can Act as DNA Mutators. Mol Cell. Nov. 2002;10(5):1247-53.

Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.

Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.

Hartung et al., Cre mutants with altered DNA binding properties. J Biol Chem. Sep. 4, 1998;273(36):22884-91.

Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.

Hasegawa et al., Spontaneous mutagenesis associated with nucleotide excision repair in *Escherichia coli*. Genes Cells. May 2008;13(5):459-69. doi: 10.1111/j.1365-2443.2008.01185.x.

Hawley-Nelson et al., Transfection of Cultured Eukaryotic Cells Using Cationic Lipid Reagents. Curr Prot Mol Biol. Jan. 2008;9.4.1-9.4.17. doi: 10.102/0471142727.mb0904s81. 17 pages.

Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.

Hector et al., CDKL5 variants: Improving our understanding of a rare neurologic disorder. Neurol Genet. Dec. 15, 2017;3(6):e200. doi: 10.1212/NXG.0000000000000200.

Heidenreich et al., Non-homologous end joining as an important mutagenic process in cell cycle-arrested cells. EMBO J. May 1, 2003;22(9):2274-83. doi: 10.1093/emboj/cdg203.

Heitz et al., Twenty years of cell-penetrating peptides: from molecular mechanisms to therapeutics. Br J Pharmacol. May 2009;157(2):195-206. doi: 10.1111/j.1476-5381.2009.00057.x. Epub Mar. 20, 2009.

Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.

Heller et al., Replisome assembly and the direct restart of stalled replication forks. Nat Rev Mol Cell Biol. Dec. 2006;7(12):932-43. Epub Nov. 8, 2006.

Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.

Hendricks et al., The S. cerevisiae Mag1 3-methyladenine DNA glycosylase modulates susceptibility to homologous recombination. DNA Repair (Amst). 2002;1(8):645-659.

Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.

Herschhorn et al., Retroviral reverse transcriptases. Cell Mol Life Sci. Aug. 2010;67(16):2717-47. doi: 10.1007/s00018-010-0346-2. Epub Apr. 1, 2010.

Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.

Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.

Heyer et al., Regulation of homologous recombination in eukaryotes. Annu Rev Genet. 2010;44:113-39. doi: 10.1146/annurev-genet-051710-150955. Author Manuscript. 33 pages.

Hickford et al., Antitumour polyether macrolides: four new halichondrins from the New Zealand deep-water marine sponge *Lissodendoryx* sp. Bioorg Med Chem. Mar. 15, 2009;17(6):2199-203. doi: 10.1016/j.bmc.2008.10.093. Epub Nov. 19, 2008.

Hida et al., Directed evolution for drug and nucleic acid; delivery. Adv Drug Deliv Rev. Dec. 22, 2007;59(15):1562-78. Epub Aug. 28, 2007.; Review.

Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.

Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.

Hill et al., Functional analysis of conserved histidines in ADP-glucose pyrophosphorylase from *Escherichia coli*.Biochem Biophys Res Commun. Mar. 17, 1998;244(2):573-7.

Hille et al., The Biology of CRISPR-Cas: Backward and Forward. Cell. Mar. 8, 2018;172(6):1239-1259. doi: 10.1016/j.cell.2017.11.032.

Hilton et al., Enabling functional genomics with genome engineering. Genome Res. Oct. 2015;25(10):1442-55. doi: 10.1101/gr.190124.115.

Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.

Hirano et al., Structural Basis for the Altered PAM Specificities of Engineered CRISPR-Cas9. Mol Cell. Mar. 17, 2016;61(6):886-94. doi: 10.1016/j.molcel.2016.02.018.

(56) References Cited

OTHER PUBLICATIONS

Hoang et al., UFBoot2: Improving the Ultrafast Bootstrap Approximation. Mol Biol Evol. Feb. 1, 2018;35(2):518-522. doi: 10.1093/molbev/msx281.

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hockemeyer et al., Genetic engineering of human pluripotent cells using TALE nucleases. Nat Biotechnol. Jul. 7, 2011;29(8):731-4. doi: 10.1038/nbt.1927.

Hoernes et al., Translating the epitranscriptome. Wiley Interdiscip Rev RNA. Jan. 2017;8(1):e1375. doi: 10.1002/wrna.1375. Epub Jun. 27, 2016.

Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.

Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.

Hollis et al., Phage integrases for the construction and manipulation of transgenic mammals. Reprod Biol Endocrinol. Nov. 7, 2003;1:79. doi: 10.1186/1477-7827-1-79.

Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.

Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.

Hondares et al., Peroxisome Proliferator-activated Receptor α (PPARα) Induces PPARγ Coactivator 1α (PGC-1α) Gene Expression and Contributes to Thermogenic Activation of Brown Fat. J Biol. Chem Oct. 2011; 286(50):43112-22. doi: 10.1074/jbc.M111.252775.

Hoogenboom et al., Natural and designer binding sites made by phage display technology. Immunol Today. Aug. 2000;21(8):371-8.

Hope et al., Cationic lipids, phosphatidylethanolamine and the intracellular delivery of polymeric, nucleic acid-based drugs (review). Mol Membr Biol. Jan.-Mar. 1998;15(1):1-14.

Horvath et al., CRISPR/Cas, the immune system of bacteria and archaea. Science. Jan. 8, 2010;327(5962):167-70. doi: 10.1126/science.1179555.

Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.

Hotta et al., [Neurotropic viruses—classification, structure and characteristics]. Nihon Rinsho. Apr. 1997;55(4):777-82. Japanese.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Houck-Loomis et al., An equilibrium-dependent retroviral mRNA switch regulates translational recoding. Nature. Nov. 27, 2011;480(7378):561-4. doi: 10.1038/nature10657.

Houdebine, The methods to generate transgenic animals and to control transgene expression. J Biotechnol. Sep. 25, 2002;98(2-3):145-60.

Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.

Houseley et al., The many pathways of RNA degradation. Cell. Feb. 20, 2009;136(4):763-76. doi: 10.1016/j.cell.2009.01.019.

Howard et al., Intracerebral drug delivery in rats with lesion-induced memory deficits. J Neurosurg. Jul. 1989;71(1):105-12.

Hower et al., Shape-based peak identification for ChIP-Seq. BMC Bioinformatics. Jan. 12, 2011;12:15. doi: 10.1186/1471-2105-12-15.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.

Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.

Hu et al., Evolved Cas9 variants with broad PAM compatibility and high DNA specificity. Nature. Apr. 5, 2018;556(7699):57-63. doi: 10.1038/nature26155. Epub Feb. 28, 2018.

Hua et al., Expanding the base editing scope in rice by using Cas9 variants. Plant Biotechnol J. Feb. 2019;17(2):499-504. doi: 10.1111/pbi.12993. Epub Oct. 5, 2018.

Hua et al., Precise A•T to G•C Base Editing in the Rice Genome. Mol Plant. Apr. 2, 2018;11(4):627-630. doi: 10.1016/j.molp.2018.02.007. Epub Feb. 21, 2018.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.

Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.

Huang et al., Heritable gene targeting in zebrafish using customized TALENs. Nat Biotechnol. Aug. 5, 2011;29(8):699-700. doi: 10.1038/nbt.1939.

Huang et al., Long-range pseudoknot interactions dictate the regulatory response in the tetrahydrofolate riboswitch. Proc Natl Acad Sci U S A. Sep. 6, 2011;108(36):14801-6. doi: 10.1073/pnas.1111701108. Epub Aug. 22, 2011.

Hubbard et al., Continuous directed evolution of DNA-binding proteins to improve TALEN specificity. Nat Methods. Oct. 2015;12(10):939-42. doi: 10.1038/nmeth.3515. Epub Aug. 10, 2015.

Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.

Humbert et al., Targeted gene therapies: tools, applications, optimization. Crit Rev Biochem Mol Biol. May-Jun. 2012;47(3):264-81. doi: 10.3109/10409238.2012.658112.

Hung et al., Protein localization in disease and therapy. J Cell Sci. Oct. 15, 2011;124(Pt 20):3381-92. doi: 10.1242/jcs.089110.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Husimi, Selection and evolution of bacteriophages in cellstat. Adv Biophys. ; 1989;25:1-43. Review.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Hwang et al., Efficient In Vivo Genome Editing Using RNA-Guided Nucleases. Nat Biotechnol. Mar. 2013; 31(3): 227-229. doi: 10.1038/nbt.2501. Epub Jan. 29, 2013.

Hwang et al., Web-based design and analysis tools for CRISPR base editing. BMC Bioinformatics. Dec. 27, 2018;19(1):542. doi: 10.1186/s12859-018-2585-4.

Händel et al., Expanding or restricting the target site repertoire of zinc-finger nucleases: the inter-domain linker as a major determinant of target site selectivity. Mol Ther. Jan. 2009;17(1):104-11. doi: 10.1038/mt.2008.233. Epub Nov. 11, 2008.

Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.

(56) References Cited

OTHER PUBLICATIONS

Iaccarino et al., hMSH2 and hMSH6 play distinct roles in mismatch binding and contribute differently to the ATPase activity of hMutSalpha. EMBO J. May 1, 1998;17(9):2677-86. doi: 10.1093/emboj/17.9.2677.

Ibba et al., Relaxing the substrate specificity of an aminoacyl-tRNA; synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Ikediobi et al., Mutation analysis of 24 known cancer genes in the NCI-60 cell line set. Mol Cancer Ther. Nov. 2006;5(11):2606-12. Epub Nov. 6, 2006.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Isaacs et al., Engineered riboregulators enable post-transcriptional control of gene expression. Nat Biotechnol. Jul. 2004;22(7):841-7. doi: 10.1038/nbt986. Epub Jun. 20, 2004.

Ishino et al., Nucleotide sequence of the iap gene, responsible for alkaline phosphatase isozyme conversion in *Escherichia coli*, and identification of the gene product. J Bacteriol. Dec. 1987;169(12):5429-33.

Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.

Iwai et al., Circular beta-lactamase: stability enhancement by cyclizing the backbone. FEBS Lett. Oct. 8, 1999;459(2):166-72. doi: 10.1016/s0014-5793(99)01220-x.

Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.

Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.

Iyer et al., DNA mismatch repair: functions and mechanisms. Chem Rev. Feb. 2006;106(2):302-23. doi: 10.1021/cr0404794.

Jaffrey et al., Emerging links between m6A and misregulated mRNA methylation in cancer. Genome Med. Jan. 12, 2017;9(1):2. doi: 10.1186/s13073-016-0395-8.

Jakimo et al., A Cas9 with Complete PAM Recognition for Adenine Dinucleotides. bioRxiv preprint. Sep. 27, 2018. doi.org/10.1101/429654. 29 pages.

Jamieson et al., Drug discovery with engineered zinc-finger proteins. Nat Rev Drug Discov. May 2003;2(5):361-8.

Jansen et al., Backbone and nucleobase contacts to glucosamine-6-phosphate in the glmS ribozyme. Nat Struct Mol Biol. Jun. 2006;13(6):517-23. Epub May 14, 2006.

Jansen et al., Identification of genes that are associated with DNA repeats in prokaryotes. Mol Microbiol. Mar. 2002;43(6):1565-75.

Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.

Jasin et al., Repair of strand breaks by homologous recombination. Cold Spring Harb Perspect Biol. Nov. 1, 2013;5(11):a012740. doi: 10.1101/cshperspect.a012740.

Jeggo, DNA breakage and repair. Adv Genet. 1998;38:185-218. doi: 10.1016/s0065-2660(08)60144-3.

Jemielity et al., Novel "anti-reverse" cap analogs with superior translational properties. RNA. Sep. 2003;9(9):1108-22. doi: 10.1261/rna.5430403.

Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.

Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.

Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.

Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

Jiang et al., Structural Biology. A Cas9-guide RNA Complex Preorganized for Target DNA Recognition. Science. Jun. 26, 2015;348(6242):1477-81. doi: 10.1126/science.aab1452.

Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.

Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

Jiricny, The multifaceted mismatch-repair system. Nat Rev Mol Cell Biol. May 2006;7(5):335-46. doi: 10.1038/nrm1907.

Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.

Johansson et al., RNA Recognition by the MS2 Phage Coat Protein. Seminars in Virology. 1997;8(3):176-85. https://doi.org/10.1006/smvy.1997.0120.

Johansson et al., Selenocysteine in proteins-properties and biotechnological use. Biochim Biophys Acta. Oct. 30, 2005;1726(1):1-13. Epub Jun. 1, 2005.

(56) References Cited

OTHER PUBLICATIONS

Johns et al., The promise and peril of continuous in vitro evolution. J Mol Evol. Aug. 2005;61(2):253-63. Epub Jun. 27, 2005.

Johnson et al., Trans insertion-splicing: ribozyme-catalyzed insertion of targeted sequences into RNAs. Biochemistry. Aug. 9, 2005;44(31):10702-10. doi: 10.1021/bi0504815.

Joho et al., Identification of a region of the bacteriophage T3 and T7 RNA polymerases that determines promoter specificity. J Mol Biol. Sep. 5, 1990;215(1):31-9.

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.

Joung et al., TALENs: a widely applicable technology for targeted genome editing. Nat Rev Mol Cell Biol. Jan. 2013; 14(1):49-55. doi: 10.1038/nrm3486. Epub Nov. 21, 2012.

Joyce et al., Amplification, mutation and selection of catalytic RNA. Gene. Oct. 15, 1989;82(1):83-7. doi: 10.1016/0378-1119(89)90033-4.

Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.

Jyothy et al., Translocation Down syndrome. Indian J Med Sci. Mar. 2002;56(3):122-6.

Kacian et al., Purification of the DNA polymerase of avian myeloblastosis virus. Biochim Biophys Acta. Sep. 24, 1971;246(3):365-83. doi: 10.1016/0005-2787(71)90773-8.

Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.

Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.

Kadyrov et al., Endonucleolytic function of MutLalpha in human mismatch repair. Cell. Jul. 28, 2006;126(2):297-308. doi: 10.1016/j.cell.2006.05.039.

Kahmann et al., G inversion in bacteriophage Mu DNA is stimulated by a site within the invertase gene and a host factor. Cell. Jul. 1985;41(3):771-80. doi: 10.1016/s0092-8674(85)80058-1.

Kaiser et al., Gene therapy. Putting the fingers on gene repair. Science. Dec. 23, 2005;310(5756):1894-6.

Kakiyama et al., A peptide release system using a photo-cleavable linker in a cell array format for cell-toxicity analysis. Polymer J. Feb. 27, 2013;45:535-9.

Kalyaanamoorthy et al., ModelFinder: fast model selection for accurate phylogenetic estimates. Nat Methods. Jun. 2017;14(6):587-589. doi: 10.1038/nmeth.4285. Epub May 8, 2017.

Kan et al., Mechanisms of precise genome editing using oligonucleotide donors. Genome Res. Jul. 2017;27(7):1099-1111. doi: 10.1101/gr.214775.116. Epub Mar. 29, 2017.

Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.

Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.

Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.

Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.

Kappel et al., Regulating gene expression in transgenic animals. Curr Opin Biotechnol. Oct. 1992;3(5):548-53.

Karimova et al., Discovery of Nigri/nox and Panto/pox site-specific recombinase systems facilitates advanced genome engineering. Sci Rep. Jul. 22, 2016;6:30130. doi: 10.1038/srep30130.

Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.

Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.

Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.

Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.

Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.

Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.

Kaufman et al., Translational efficiency of polycistronic mRNAs and their utilization to express heterologous genes in mammalian cells. EMBO J. Jan. 1987;6(1):187-93.

Kavli et al., Excision of cytosine and thymine from DNA by mutants of human uracil-DNA glycosylase. EMBO J. Jul. 1, 1996;15(13):3442-7.

Kawarasaki et al., Enhanced crossover SCRATCHY: construction and high-throughput screening of a combinatorial library containing multiple non-homologous crossovers. Nucleic Acids Res. Nov. 1, 2003;31(21):e126.

Kay et al., Viral vectors for gene therapy: the art of turning infectious agents into vehicles of therapeutics. Nat Med. Jan. 2001;7(1):33-40.

Kaya et al., A bacterial Argonaute with noncanonical guide RNA specificity. Proc. Natl. Acad. Sci. USA Apr. 2016;113(15):4057-62.

Keijzers et al., Human exonuclease 1 (EXO1) activity characterization and its function on flap structures. Biosci Rep. Apr. 25, 2015;35(3):e00206. doi: 10.1042/BSR20150058.

Kellendonk et al., Regulation of Cre recombinase activity by the synthetic steroid RU 486. Nucleic Acids Res. Apr. 15, 1996;24(8):1404-11.

Kelman, PCNA: structure, functions and interactions. Oncogene. Feb. 13, 1997;14(6):629-40. doi: 10.1038/sj.onc.1200886.

Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.

Kessel et al., Murine developmental control genes. Science. Jul. 27, 1990;249(4967):374-9. doi: 10.1126/science.1974085.

Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.

Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.

Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.

Kilbride et al., Determinants of product topology in a hybrid Cre-Tn3 resolvase site-specific recombination system. J Mol Biol. Jan. 13, 2006;355(2):185-95. Epub Nov. 9, 2005.

Kilcher et al., Brochothrix thermosphacta bacteriophages feature heterogeneous and highly mosaic genomes and utilize unique

(56) References Cited

OTHER PUBLICATIONS prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., An anionic human protein mediates cationic liposome delivery of genome editing proteins into mammalian cells. Nat Commun. Jul. 2, 2019;10(1):2905. doi: 10.1038/s41467-019-10828-3.
Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Hybrid restriction enzymes: zinc finger fusions to Fok I cleavage domain. Proc Natl Acad Sci U S A. Feb. 6, 1996;93(3):1156-60.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
Kim et al., Rescue of high-specificity Cas9 variants using sgRNAs with matched 5' nucleotides. Genome Biol. Nov. 15, 2017;18(1):218. doi: 10.1186/s13059-017-1355-3.
Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
King et al., No gain, no pain: NaV1.7 as an analgesic target. ACS Chem Neurosci. Sep. 17, 2014;5(9):749-51. doi: 10.1021/cn500171p. Epub Aug. 11, 2014.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 RNA polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Klug et al., Zinc fingers: a novel protein fold for nucleic acid recognition. Cold Spring Harb Symp Quant Biol. 1987;52:473-82.
Knott et al., CRISPR-Cas guides the future of genetic engineering. Science. Aug. 31, 2018;361(6405):866-869. doi: 10.1126/science.aat5011.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.

(56) References Cited

OTHER PUBLICATIONS

Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.

Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.

Kolb et al., Click Chemistry: Diverse Chemical Function from a Few Good Reactions. Angew Chem Int Ed Engl. Jun. 1, 2001;40(11):2004-2021.

Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.

Kolot et al., Site-specific recombination in mammalian cells expressing the Int recombinase of bacteriophage HK022. Mol Biol Rep. Aug. 1999;26(3):207-13. doi: 10.1023/a:1007096701720.

Komor et al., CRISPR-Based Technologies for the Manipulation of Eukaryotic Genomes. Cell. Jan. 12, 2017;168(1-2):20-36. doi: 10.1016/j.cell.2016.10.044.

Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.

Komor et al., Programmable editing of a target base in genomic DNA without double-stranded DNA cleavage. Nature. Apr. 20, 2016;533(7603):420-4. doi: 10.1038/nature17946.

Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.

Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.

Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.

Koonin et al., Diversity, classification and evolution of CRISPR-Cas systems. Curr Opin Microbiol. 2017;37:67-78. doi:10.1016/j.mib.2017.05.008.

Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.

Kotewicz et al., Cloning and overexpression of Moloney murine leukemia virus reverse transcriptase in *Escherichia coli*. Gene. 1985;35(3):249-58. doi: 10.1016/0378-1119(85)90003-4.

Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.

Kotin, Prospects for the use of adeno-associated virus as a vector for human gene therapy. Hum Gene Ther. Jul. 1994;5(7):793-801. doi: 10.1089/hum.1994.5.7-793.

Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.

Kowal et al., Exploiting unassigned codons in Micrococcus luteus for tRNA-based amino acid mutagenesis. Nucleic Acids Res. Nov. 15, 1997;25(22):4685-9.

Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.

Kozak, An analysis of 5'-noncoding sequences from 699 vertebrate messenger RNAs. Nucleic Acids Res. Oct. 26, 1987;15(20):8125-48. doi: 10.1093/nar/15.20.8125.

Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.

Kremer et al., Adenovirus and adeno-associated virus mediated gene transfer. Br Med Bull. Jan. 1995;51(1):31-44. doi: 10.1093/oxfordjournals.bmb.a072951.

Krishna et al., Structural classification of zinc fingers: survey and summary. Nucleic Acids Res. Jan. 15, 2003;31(2):532-50.

Krokan et al., Uracil in DNA—occurrence, consequences and repair. Oncogene. Dec. 16, 2002;21(58):8935-48. doi: 10.1038/sj.onc.1205996.

Krokan et al., Base excision repair. Cold Spring Harb Perspect Biol. Apr. 1, 2013;5(4):a012583. doi: 10.1101/cshperspect.a012583.

Krzywkowski et al., Limited reverse transcriptase activity of phi29 DNA polymerase. Nucleic Acids Res. Apr. 20, 2018;46(7):3625-3632. doi: 10.1093/nar/gky190.

Ku et al., Nucleic Acid Aptamers: An Emerging Tool for Biotechnology and Biomedical Sensing. Sensors (Basel). Jul. 6, 2015;15(7):16281-313. doi: 10.3390/s150716281.

Kuan et al., A systematic evaluation of nucleotide properties for CRISPR sgRNA design. BMC Bioinformatics. Jun. 6, 2017;18(1):297. doi: 10.1186/s12859-017-1697-6.

Kumar et al., Gene therapy for chronic neuropathic pain: how does it work and where do we stand today? Pain Med. May 2011;12(5):808-22. doi: 10.1111/j.1526-4637.2011.01120.x.

Kumar et al., Structural and functional consequences of the mutation of a conserved arginine residue in alphaA and alphaB crystallins. J Biol Chem. Aug. 20, 1999;274(34):24137-41.

Kundu et al., Leucine to proline substitution by SNP at position 197 in Caspase-9 gene expression leads to neuroblastoma: a bioinformatics analysis. 3 Biotech. 2013; 3:225-34.

Kunkel et al., DNA mismatch repair. Annu Rev Biochem. 2005;74:681-710. doi: 10.1146/annurev.biochem.74.082803.133243.

Kunkel et al., Eukaryotic Mismatch Repair in Relation to DNA Replication. Annu Rev Genet. 2015;49:291-313. doi: 10.1146/annurev-genet-112414-054722.

Kunz et al., DNA Repair in mammalian cells: Mismatched repair: variations on a theme. Cell Mol Life Sci. Mar. 2009;66(6):1021-38. doi: 10.1007/s00018-009-8739-9.

Kurjan et al., Structure of a yeast *Pheromone* gene (MF alpha): a putative alpha-factor precursor contains four tandem copies of mature alpha-factor. Cell. Oct. 1982;30(3):933-43. doi: 10.1016/0092-8674(82)90298-7.

Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.

Kuscu et al., CRISPR-Cas9-AID base editor is a powerful gain-of-function screening tool. Nat Methods. Nov. 29, 2016;13(12):983-984. doi: 10.1038/nmeth.4076.

Kuscu et al., CRISPR-STOP: gene silencing through base-editing-induced nonsense mutations. Nat Methods. Jul. 2017;14(7):710-712. doi: 10.1038/nmeth.4327. Epub Jun. 5, 2017.

Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.

Kwart et al., Precise and efficient scarless genome editing in stem cells using CORRECT. Nat Protoc. Feb. 2017;12(2):329-354. doi: 10.1038/nprot.2016.171. Epub Jan. 19, 2017.

Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.

Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.

Kwon et al., Chemical basis of glycine riboswitch cooperativity. RNA. Jan. 2008;14(1):25-34. Epub Nov. 27, 2007.

(56) References Cited

OTHER PUBLICATIONS

Köhrer et al., A possible approach to site-specific insertion of two different unnatural amino acids into proteins in mammalian cells via nonsense suppression. Chem Biol. Nov. 2003;10(11):1095-102.

Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.

Kügler et al., Human synapsin 1 gene promoter confers highly neuron-specific long-term transgene expression from an adenoviral vector in the adult rat brain depending on the transduced area. Gene Ther. Feb. 2003;10(4):337-47. doi: 10.1038/sj.gt.3301905.

Lada et al., Mutator effects and mutation signatures of editing deaminases produced in bacteria and yeast. Biochemistry (Mosc). Jan. 2011;76(1):131-46.

Lahue et al., DNA mismatch correction in a defined system. Science. Jul. 14, 1989;245(4914):160-4. doi: 10.1126/science. 2665076.

Lakich et al., Inversions disrupting the factor VIII gene are a common cause of severe haemophilia A. Nat Genet. Nov. 1993;5(3):236-41. doi: 10.1038/ng1193-236.

Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.

Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.

Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.

Langer et al., Chemical and Physical Structure of Polymers as Carriers for Controlled Release of Bioactive Agents: A Review. J Macromol Sci, Part C, 1983;23(1):61-126. doi: 10.1080/07366578308079439.

Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.

Langer et al., New methods of drug delivery. Science. Sep. 28, 1990;249(4976):1527-33.

Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.

Lau et al., Molecular basis for discriminating between normal and damaged bases by the human alkyladenine glycosylase, AAG. Proc Natl Acad Sci U S A. Dec. 5, 2000;97(25):13573-8.

Lauer et al., Construction, characterization, and use of two Listeria monocytogenes site-specific phage integration vectors. J Bacteriol. Aug. 2002;184(15):4177-86. doi: 10.1128/jb.184.15.4177-4186. 2002.

Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.

Lawrence et al., Supercharging proteins can impart unusual resilience. J Am Chem Soc. Aug. 22, 2007;129(33):10110-2. Epub Aug. 1, 2007.

Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.

Lazar et al., Transforming growth factor alpha: mutation of aspartic acid 47 and leucine 48 results in different biological activities. Mol Cell Biol. Mar. 1988;8(3):1247-52.

Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.

Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.

Le Grice et al., Purification and characterization of recombinant equine infectious anemia virus reverse transcriptase. J Virol. Dec. 1991;65(12):7004-7. doi: 10.1128/JVI.65.12.7004-7007.1991.

Leach et al., Mutations of a mutS homolog in hereditary nonpolyposis colorectal cancer. Cell. Dec. 17, 1993;75(6):1215-25. doi: 10.1016/0092-8674(93)90330-s.

Leaver-Fay et al., ROSETTA3: an object-oriented software suite for the simulation and design of macromolecules. Methods Enzymol. 2011;487:545-74. doi: 10.1016/B978-0-12-381270-4.00019-6.

Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.

Lee et al., An allosteric self-splicing ribozyme triggered by a bacterial second messenger. Science. Aug. 13, 2010;329(5993):845-8. doi: 10.1126/science.1190713.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.

Lee et al., Simultaneous targeting of linked loci in mouse embryos using base editing. Sci Rep. Feb. 7, 2019;9(1):1662. doi: 10.1038/s41598-018-33533-5.

Lee et al., Site-specific integration of mycobacteriophage L5: integration-proficient vectors for *Mycobacterium smegmatis, Mycobacterium tuberculosis,* and bacille Calmette-Guérin. Proc Natl Acad Sci U S A. Apr. 15, 1991;88(8):3111-5. doi: 10.1073/pnas.88.8.3111.

Lee et al., Synthetically modified guide RNA and donor DNA are a versatile platform for CRISPR-Cas9 engineering. Elife. May 2, 2017;6:e25312. doi: 10.7554/eLife.25312.

Lee et al., Targeted chromosomal deletions in human cells using zinc finger nucleases. Genome Res. Jan. 2010 20: 81-89; Published in Advance Dec. 1, 2009, doi:10.1101/gr.099747.109.

Lee et al., Targeting fidelity of adenine and cytosine base editors in mouse embryos. Nat Commun. Nov. 15, 2018;9(1):4804. doi: 10.1038/s41467-018-07322-7.

Lee et al., Transcriptional regulation and its misregulation in disease. Cell. Mar. 14, 2013;152(6):1237-51. doi: 10.1016/j.cell. 2013.02.014.

Lefebvre et al., Identification and characterization of a spinal muscular atrophy-determining gene. Cell. Jan. 13, 1995;80(1):155-65. doi: 10.1016/0092-8674(95)90460-3.

Lei et al., Efficient targeted gene disruption in Xenopus embryos using engineered transcription activator-like effector nucleases

(56) References Cited

OTHER PUBLICATIONS (TALENs). Proc Natl Acad Sci U S A. Oct. 23, 2012;109(43):17484-9. Doi: 10.1073/pnas.1215421109. Epub Oct. 8, 2012.

Lei et al., Site-specificity of serine integrase demonstrated by the attB sequence preference of ΦBT1 integrase. FEBS Lett. Apr. 2018;592(8):1389-1399. doi: 10.1002/1873-3468.13023. Epub Mar. 25, 2018.

Leipold et al., A de novo gain-of-function mutation in SCN11A causes loss of pain perception. Nat Genet. Nov. 2013;45(11):1399-404. doi: 10.1038/ng.2767. Epub Sep. 15, 2013.

Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.

Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.

Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.

Levy et al., Inhibition of calcification of bioprosthetic heart valves by local controlled-release diphosphonate. Science. Apr. 12, 1985;228(4696):190-2.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.

Lew et al., Protein splicing in vitro with a semisynthetic two-component minimal intein. J Biol Chem. Jun. 26, 1998;273(26):15887-90. doi: 10.1074/jbc.273.26.15887.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Building the Class 2 CRISPR-Cas Arsenal. Mol Cell 2017;65(3);377-379.

Lewis et al., Codon 129 polymorphism of the human prion protein influences the kinetics of amyloid formation. J Gen Virol. Aug. 2006;87(Pt 8):2443-9.

Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li, Mechanisms and functions of DNA mismatch repair. Cell Res. Jan. 2008;18(1):85-98. doi: 10.1038/cr.2007.115.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Base editing with a Cpf1-cytidine deaminase fusion. Nat Biotechnol. Apr. 2018;36(4):324-327. doi: 10.1038/nbt.4102. Epub Mar. 19, 2018.

Li et al., Current approaches for engineering proteins with diverse biological properties. Adv Exp Med Biol. 2007;620:18-33.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.

Li et al., Loss of post-translational modification sites in disease. Pac Symp Biocomput. 2010:337-47. doi: 10.1142/9789814295291_0036.

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., Multiplex and homologous recombination-mediated genome editing in *Arabidopsis* and *Nicotiana benthamiana* using guide RNA and Cas9. Nat Biotechnol. Aug. 2013;31(8):688-91. doi: 10.1038/nbt.2654.

Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.

Li et al., Protein trans-splicing as a means for viral vector-mediated in vivo gene therapy. Hum Gene Ther. Sep. 2008;19(9):958-64. doi: 10.1089/hum.2008.009.

Li et al., RSEM: accurate transcript quantification from RNA-Seq data with or without a reference genome. BMC Bioinformatics. Aug. 4, 2011;12:323. doi: 10.1186/1471-2105-12-323.

Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.

Liang et al., Correction of β-thalassemia mutant by base editor in human embryos. Protein Cell. Nov. 2017;8(11):811-822. doi: 10.1007/s13238-017-0475-6. Epub Sep. 23, 2017.

Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.

Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.

Liao et al., One-step assembly of large CRISPR arrays enables multi-functional targeting and reveals constraints on array design. bioRxiv. May 2, 2018. doi: 10.1101/312421. 45 pages.

Lieber et al., Mechanism and regulation of human non-homologous DNA end-joining. Nat Rev Mol Cell Biol. Sep. 2003;4(9):712-20.

Liefke et al., The oxidative demethylase ALKBH3 marks hyperactive gene promoters in human cancer cells. Genome Med. Jun. 30, 2015;7(1):66. doi: 10.1186/s13073-015-0180-0.

Lienert et al., Two- and three-input TALE-based and logic computation in embryonic stem cells. Nucleic Acids Res. Nov. 2013;41(21):9967-75. doi: 10.1093/nar/gkt758. Epub Aug. 27, 2013.

Lilley, D.M. The Varkud Satellite Ribozyme. RNA. Feb. 2004;10(2):151-8.doi: 10.1261/rna.5217104.

Lim et al., Crystal structure of the moloney murine leukemia virus RNase H domain. J Virol. Sep. 2006;80(17):8379-89. doi: 10.1128/JVI.00750-06.

Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.

Lin et al., [Construction and evaluation of DnaB split intein high expression vector and a six amino acids cyclic peptide library]. Sheng Wu Gong Cheng Xue Bao. Nov. 2008;24(11):1924-30. Chinese.

Lin et al., Enhanced homology-directed human genome engineering by controlled timing of CRISPR/Cas9 delivery. Elife. Dec. 15, 2014;3:e04766. doi: 10.7554/eLife.04766.

Lin et al., The human REV1 gene codes for a DNA template-dependent dCMP transferase. Nucleic Acids Res. Nov. 15, 1999;27(22):4468-75. doi: 10.1093/nar/27.22.4468.

(56) References Cited

OTHER PUBLICATIONS

Lindahl, T., Instability and decay of the primary structure of DNA. Nature. Apr. 22, 1993;362(6422):709-15. doi: 10.1038/362709a0.

Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.

Liu et al., C2c1-sgRNA Complex Structure Reveals RNA-Guided DNA Cleavage Mechanism. Molecular Cell Jan. 2017;65(2):310-22.

Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.

Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.

Liu et al., Adding new chemistries to the genetic code. Annu Rev Biochem. 2010;79:413-44. doi: 10.1146/annurev.biochem.052308.105824.

Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.

Liu et al., Balancing AID and DNA repair during somatic hypermutation. Trends Immunol. Apr. 2009;30(4):173-81. doi: 10.1016/j.it.2009.01.007.

Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.

Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.

Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.

Liu et al., Design of polydactyl zinc-finger proteins for unique addressing within complex genomes. Proc Natl Acad Sci U S A. May 27, 1997;94(11):5525-30.

Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.

Liu et al., Distance determination by GIY-YIG intron endonucleases: discrimination between repression and cleavage functions. Nucleic Acids Res. Mar. 31, 2006;34(6):1755-64. Print 2006.

Liu et al., Editing DNA Methylation in the Mammalian Genome. Cell. Sep. 22, 2016;167(1):233-247.e17. doi: 10.1016/j.cell.2016.08.056.

Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.

Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.

Liu et al., Fast Colorimetric Sensing of Adenosine and Cocaine Based on a General Sensor Design Involving Aptamers and Nanoparticles. Angew Chem. 2006;118(1):96-100.

Liu et al., Flap endonuclease 1: a central component of DNA metabolism. Annu Rev Biochem. 2004;73:589-615. doi:10.1146/annurev.biochem.73.012803.092453.

Liu et al., Functional Nucleic Acid Sensors. Chem Rev. May 2009;109(5):1948-98. doi: 10.1021/cr030183i.

Liu et al., Genetic incorporation of unnatural amino acids into proteins in mammalian cells. Nat Methods. Mar. 2007;4(3):239-44. Epub Feb. 25, 2007.

Liu et al., Highly efficient RNA-guided base editing in rabbit. Nat Commun. Jul. 13, 2018;9(1):2717. doi: 10.1038/s41467-018-05232-2.

Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.

Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.

Liu et al., N(6)-methyladenosine-dependent RNA structural switches regulate RNA-protein interactions. Nature. Feb. 26, 2015;518(7540):560-4. doi: 10.1038/nature14234.

Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.

Liu et al., Reverse transcriptase of foamy virus. Purification of the enzymes and immunological identification. Arch Virol. 1977;55(3):187-200. doi: 10.1007/BF01319905.

Liu et al., Reverse transcriptase-mediated tropism switching in Bordetella bacteriophage. Science. Mar. 15, 2002;295(5562):2091-4. doi: 10.1126/science.1067467.

Liu et al., Saccharomyces cerevisiae flap endonuclease 1 uses flap equilibration to maintain triplet repeat stability. Mol Cell Biol. May 2004;24(9):4049-64. doi: 10.1128/MCB.24.9.4049-4064.2004.

Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.

Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.

Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.

Lombardo et al., Gene editing in human stem cells using zinc finger nucleases and integrase-defective lentiviral vector delivery. Nat Biotechnol. Nov. 2007;25(11):1298-306. Epub Oct. 28, 2007.

Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.

Longsworth, Expanding the Enzymatic Activity of the Programmable Endonuclease Cas9 in Zebrafish. Thesis. Rice University. Houston, TX. Aug. 2018. 41 pages.

Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.

Lorenz et al., ViennaRNA Package 2.0. Algorithms Mol Biol. Nov. 24, 2011;6:26. doi: 10.1186/1748-7188-6-26.

Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.

Losey et al., Crystal structure of Staphylococcus sureus tRNA adenosine deaminase tadA in complex with RNA. Nature Struct. Mol. Biol. Feb. 2006;13(2):153-9.

Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.

Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.

Luckow et al., High level expression of nonfused foreign genes with Autographa californica nuclear polyhedrosis virus expression vectors. Virology. May 1989;170(1):31-9. doi: 10.1016/0042-6822(89)90348-6.

Lujan et al., Heterogeneous polymerase fidelity and mismatch repair bias genome variation and composition. Genome Res. Nov. 2014;24(11):1751-64. doi: 10.1101/gr.178335.114. Epub Sep. 12, 2014.

(56) References Cited

OTHER PUBLICATIONS

Lukacsovich et al., Repair of a specific double-strand break generated within a mammalian chromosome by yeast endonuclease I-SceI. Nucleic Acids Res. Dec. 25, 1994;22(25):5649-57. doi: 10.1093/nar/22.25.5649.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.
Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.
Lynch, Evolution of the mutation rate. Trends Genet. Aug. 2010;26(8):345-52. doi: 10.1016/j.tig.2010.05.003. Epub Jun. 30, 2010.
Lyons et al., Efficient Recognition of an Unpaired Lesion by a DNA Repair Glycosylase. J. Am. Chem. Soc., 2009;131(49):17742-3. DOI: 10.1021/ja908378y.
Lüke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.
Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.
Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.
Ma et al., In vitro protein engineering using synthetic tRNA(Ala) with different anticodons. Biochemistry. Aug. 10, 1993;32(31):7939-45.
Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Ma et al., Targeted AID-mediated mutagenesis (TAM) enables efficient genomic diversification in mammalian cells. Nature Methods. Oct. 2016;13:1029-35. doi:10.1038/nmeth.4027.
Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.
Macbeth et al., Inositol hexakisphosphate is bound in the ADAR2 core and required for RNA editing. Science. Sep. 2, 2005;309(5740):1534-9. doi: 10.1126/science.1113150.
MacFadden et al., Mechanism and structural diversity of exoribonuclease-resistant RNA structures in flaviviral RNAs. Nat Commun. Jan. 9, 2018;9(1):119. doi: 10.1038/s41467-017-02604-y.
MacRae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.
Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.
Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.
Maizels et al., Initiation of homologous recombination at DNA nicks. Nucleic Acids Res. Aug. 21, 2018;46(14):6962-6973. doi: 10.1093/nar/gky588.
Maji et al., A High-Throughput Platform to Identify Small-Molecule Inhibitors of CRISPR-Cas9. Cell. May 2, 2019;177(4):1067-1079. e19. doi: 10.1016/j.cell.2019.04.009.
Mak et al., The crystal structure of TAL effector PthXo1 bound to its DNA target. Science. Feb. 10, 2012;335(6069):716-9. doi: 10.1126/science.1216211. Epub Jan. 5, 2012.
Makarova et al., Prokaryotic homologs of Argonaute proteins are predicted to function as key components of a novel system of defense against mobile genetic elements. Biology Direct 2009;4:29.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Classification and Nomenclature of CRISPR-Cas Systems: Where from Here? Crispr J. Oct. 2018;1(5):325-336. doi: 10.1089/crispr.2018.0033.
Makarova et al., Evolution and classification of the CRISPR-Cas systems. Nat Rev Microbiol. Jun. 2011;9(6):467-77. doi: 10.1038/nrmicro2577. Epub May 9, 2011.
Makarova et al., Prokaryotic homologs of Argonaute proteins are predicted to function as key components of a novel system of defense against mobile genetic elements. Biology Direct 2009;4:29. doi: 10.1186/1745-6150-4-29.
Makeyev et al., Evolutionary potential of an RNA virus. J Virol. Feb. 2004;78(4):2114-20.
Malashkevich et al., Crystal structure of tRNA adenosine deaminase TadA from Escherichia coli. Deposited: 2005-03-10 Released: 2006-02-21 doi:10.2210/pdb1z3a/pdb (2006).
Mali et al., Cas9 as a versatile tool for engineering biology. Nat Methods. Oct. 2013; 10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8, Supplemental Info. doi: 10.1038/nbt.2675. Epub Aug. 1, 2013.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 1, 20135;339(6121):823-6. doi: 10.1126/science.1232033. Epub Jan. 3, 2013.
Malito et al., Structural basis for lack of toxicity of the diphtheria toxin mutant CRM197. Proc Natl Acad Sci U S A. Apr. 3, 2012;109(14):5229-34. doi: 10.1073/pnas. 1201964109. Epub Mar. 1, 20129.
Mandal et al., A glycine-dependent riboswitch that uses cooperative binding to control gene expression. Science. Oct. 8, 2004;306(5694):275-9.

(56) References Cited

OTHER PUBLICATIONS

Mandal et al., Adenine riboswitches and gene activation by disruption of a transcription terminator. Nat Struct Mol Biol. Jan. 2004;11(1):29-35. Epub Dec. 29, 2003.
Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.
Mani et al., Design, engineering, and characterization of zinc finger nucleases. Biochem Biophys Res Commun. Sep. 23, 2005;335(2):447-57.
Marceau, Functions of single-strand DNA-binding proteins in DNA replication, recombination, and repair. Methods Mol Biol. 2012;922:1-21. doi: 10.1007/978-1-62703-032-8_1.
Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.
Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.
Marioni et al., DNA methylation age of blood predicts all-cause mortality in later life. Genome Biol. Jan. 30, 2015;16:25. doi: 10.1186/s13059-015-0584-6.
Marquart et al., Predicting base editing outcomes with an attention-based deep learning algorithm trained on high-throughput target library screeen. bioRxiv. Jul. 5, 2020. DOI:10.1101/2020.07.05.186544. Retrieved from the Internet via https://www.biorxiv.org/content/10.1101/2020.07.05.186544v1.full.pdf lased accessed on Apr. 28, 2021.
Marraffini et al., CRISPR interference limits horizontal gene transfer in staphylococci by targeting DNA. Science. Dec. 19, 2008;322(5909):1843-5. doi: 10.1126/science.1165771.
Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.
Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.
Martsolf et al., Complete trisomy 17p a relatively new syndrome. Ann Genet. 1988;31(3):172-4.
Martz, L., Nav-i-gating antibodies for pain. Science-Business eXchange. Jun. 12, 2014;7(662):1-2. doi: 10.1038/scibx.2014.662.
Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Mascola et al., HIV-1 neutralizing antibodies: understanding nature's pathways. Immunol Rev. Jul. 2013;254(1):225-44. doi: 10.1111/imr.12075.
Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.
Mathys et al., Characterization of a self-splicing mini-intein and its conversion into autocatalytic N- and C-terminal cleavage elements: facile production of protein building blocks for protein ligation. Gene. Apr. 29, 1999;231(1-2):1-13. doi: 10.1016/s0378-1119(99)00103-1.
Matsuura et al., A gene essential for the site-specific excision of actinophage r4 prophage genome from the chromosome of a lysogen. J Gen Appl Microbiol. 1995;41(1):53-61.
Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.
May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.
McCarroll et al., Copy-number variation and association studies of human disease. Nat Genet. Jul. 2007;39(7 Suppl):S37-42. doi: 10.1038/ng2080.
McDonald et al., Characterization of mutations at the mouse phenylalanine hydroxylase locus. Genomics. Feb. 1, 1997;39(3):402-5. doi: 10.1006/geno.1996.4508.
McInerney et al., Error Rate Comparison during Polymerase Chain Reaction by DNA Polymerase. Mol Biol Int. 2014;2014:287430. doi: 10.1155/2014/287430. Epub Aug. 17, 2014.
McKenna et al., Recording development with single cell dynamic lineage tracing. Development. Jun. 27, 2019;146(12):dev169730. doi: 10.1242/dev.169730.
McKenna et al., Whole-organism lineage tracing by combinatorial and cumulative genome editing. Science. Jul. 29, 2016;353(6298):aaf7907. doi: 10.1126/science.aaf7907. Epub May 26, 2016.
McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.
McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.
Mead et al., A novel protective prion protein variant that colocalizes with kuru exposure. N Engl J Med. Nov. 19, 2009;361(21):2056-65. doi: 10.1056/NEJMoa0809716.
Meckler et al., Quantitative analysis of TALE-DNA interactions suggests polarity effects. Nucleic Acids Res. Apr. 2013;41(7):4118-28. doi: 10.1093/nar/gkt085. Epub Feb. 13, 2013.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.
Mendell et al., Single-Dose Gene-Replacement Therapy for Spinal Muscular Atrophy. N Engl J Med. Nov. 2, 2017;377(18):1713-1722. doi: 10.1056/NEJMoa1706198.
Meng et al., Profiling the DNA-binding specificities of engineered Cys2His2 zinc finger domains using a rapid cell-based method. Nucleic Acids Res. 2007;35(11):e81. Epub May 30, 2007.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.
Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.
Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Mertens et al., Site-specific recombination in bacteriophage Mu: characterization of binding sites for the DNA invertase Gin. EMBO J. Apr. 1988;7(4):1219-27.
Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.
Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.
Meyer et al., Confirmation of a second natural preQ1 aptamer class in Streptococcaceae bacteria. RNA. Apr. 2008;14(4):685-95. doi: 10.1261/rna.937308. Epub Feb. 27, 2008.

(56) References Cited

OTHER PUBLICATIONS

Meyer et al., Library generation by gene shuffling. Curr Protoc Mol Biol. Jan. 6, 2014;105:Unit 15.12.. doi: 10.1002/0471142727. mb1512s105.

Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.

Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.

Michel et al., Mitochondrial class II introns encode proteins related to the reverse transcriptases of retroviruses. Nature. Aug. 15-21, 1985;316(6029):641-3. doi: 10.1038/316641a0.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.

Mihai et al., PTEN inhibition improves wound healing in lung epithelia through changes in cellular mechanics that enhance migration. Am J Physiol Lung Cell Mol Physiol. 2012;302(3):L287-L299.

Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.

Miller et al., A TALE nuclease architecture for efficient genome editing. Nat Biotechnol. Feb. 2011;29(2):143-8. doi:10.1038/nbt. 1755. Epub Dec. 22, 2010.

Miller et al., An improved zinc-finger nuclease architecture for highly specific genome editing. Nat Biotechnol. Jul. 2007;25(7):778-85. Epub Jul. 1, 2007.

Miller et al., Construction and properties of retrovirus packaging cells based on gibbon ape leukemia virus. J Virol. May 1991;65(5):2220-4. doi: 10.1128/JVI.65.5.2220-2224.1991.

Miller, Human gene therapy comes of age. Nature. Jun. 11, 1992;357(6378):455-60. doi: 10.1038/357455a0.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Mills et al., Protein splicing in trans by purified N- and C-terminal fragments of the *Mycobacterium tuberculosis* RecA intein. Proc Natl Acad Sci U S A. Mar. 31, 1998;95(7):3543-8. doi: 10.1073/pnas.95.7.3543.

Min et al., Deep learning in bioinformatics. Brief Bioinform. Sep. 1, 2017;18(5):851-869. doi: 10.1093/bib/bbw068.

Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.

Minoretti et al., A W148R mutation in the human FOXD4 gene segregating with dilated cardiomyopathy, obsessive-compulsive disorder, and suicidality. Int J Mol Med. Mar. 2007;19(3):369-72.

Mir et al., Two Active Site Divalent Ions in the Crystal Structure of the Hammerhead Ribozyme Bound to a Transition State Analogue. Biochemistry. . Feb. 2, 2016;55(4):633-6. doi: 10.1021/acs.biochem. 5b01139. Epub Jan. 19, 2016.

Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.

Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.

Mitani et al., Delivering therapeutic genes—matching approach and application. Trends Biotechnol. May 1993;11(5):162-6. doi: 10.1016/0167-7799(93)90108-L.

Mitton-Fry et al., Poly(A) tail recognition by a viral RNA element through assembly of a triple helix. Science. Nov. 26, 2010;330(6008):1244-7. doi: 10.1126/science.1195858.

Miyaoka et al., Systematic quantification of HDR and NHEJ reveals effects of locus, nuclease, and cell type on genome-editing. Sci Rep. Mar. 31, 2016;6:23549. doi: 10.1038/srep23549.

Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714. e8. doi: 10.1016/j.molcel.2018.09.013. Epub Oct. 18, 2018.

Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714. e8. doi: 10.1016/j.molcel.2018.09.013. Epub Oct. 18, 2018. Including Supplemental Information.

Mohr et al., Thermostable group II intron reverse transcriptase fusion proteins and their use in cDNA synthesis and next-generation RNA sequencing. RNA. Jul. 2013;19(7):958-70. doi: 10.1261/rna. 039743.113. Epub May 22, 2013.

Mojica et al., Intervening sequences of regularly spaced prokaryotic repeats derive from foreign genetic elements. J Mol Evol. Feb. 2005;60(2):174-82.

Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.

Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.

Mol et al., Crystal structure of human uracil-DNA glycosylase in complex with a protein inhibitor: protein mimicry of DNA. Cell. Sep. 8, 1995;82(5):701-8.

Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.

Monahan et al., Site-specific incorporation of unnatural amino acids into receptors expressed in Mammalian cells. Chem Biol. Jun. 2003;10(6):573-80.

Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.

Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.

Montange et al., Structure of the S-adenosylmethionine riboswitch regulatory mRNA element. Nature. Jun. 29, 2006;441(7097):1172-5.

Moore et al., Improved somatic mutagenesis in zebrafish using transcription activator-like effector nucleases (TALENs). PLoS One. 2012;7(5):e37877. Doi: 10.1371/journal.pone.0037877. Epub May 24, 2012.

Mootz et al., Conditional protein splicing: a new tool to control protein structure and function in vitro and in vivo. J Am Chem Soc. Sep. 3, 2003;125(35):10561-9.

Mootz et al., Protein splicing triggered by a small molecule. J Am Chem Soc. Aug. 7, 2002;124(31):9044-5 and Supporting Information. doi: 10.1021/ja026769o. 4 pages.

Mootz et al., Protein splicing triggered by a small molecule. J Am Chem Soc. Aug. 7, 2002;124(31):9044-5.

Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.

Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.

(56) References Cited

OTHER PUBLICATIONS

Morita et al., The site-specific recombination system of actinophage TG1. FEMS Microbiol Lett. Aug. 2009;297(2):234-40. doi: 10.1111/j.1574-6968.2009.01683.x.

Morris et al., A peptide carrier for the delivery of biologically active proteins into mammalian cells. Nat Biotechnol. Dec. 2001;19(12):1173-6.

Moscou et al., A simple cipher governs DNA recognition by TAL effectors. Science. Dec. 11, 2009;326(5959):1501. doi: 10.1126/science.1178817.

Mougiakos et al., Characterizing a thermostable Cas9 for bacterial genome editing and silencing. Nat Commun. Nov. 21, 2017;8(1):1647. doi: 10.1038/s41467-017-01591-4.

Muir et al., Expressed protein ligation: a general method for protein engineering. Proc Natl Acad Sci U S A. Jun. 9, 1998;95(12):6705-10. doi: 10.1073/pnas.95.12.6705.

Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.

Muller, U.F., Design and Experimental Evolution of trans-Splicing Group I Intron Ribozymes. Molecules. Jan. 2, 2017;22(1):75. doi: 10.3390/molecules22010075.

Mullins et al., Transgenesis in nonmurine species. Hypertension. Oct. 1993;22(4):630-3.

Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.

Murphy, Phage recombinases and their applications. Adv Virus Res. 2012;83:367-414. doi: 10.1016/B978-0-12-394438-2.00008-6. Review.

Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.

Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.

Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.

Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.

Muzyczka et al., Adeno-associated virus (AAV) vectors: will they work? J Clin Invest. Oct. 1994;94(4):1351. doi: 10.1172/JCI117468.

Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.

Myers et al., Insulin signal transduction and the IRS proteins. Annu Rev Pharmacol Toxicol. 1996;36:615-58. doi: 10.1146/annurev.pa.36.040196.003151.

Nabel et al., Direct gene transfer for immunotherapy and immunization. Trends Biotechnol. May 1993;11(5):211-5. doi: 10.1016/0167-7799(93)90117-R.

Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.

Nahvi et al., Coenzyme B12 riboswitches are widespread genetic control elements in prokaryotes. Nucleic Acids Res. Jan. 2, 2004;32(1):143-50.

Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.

Nakamura et al., Codon usage tabulated from international DNA sequence databases: status for the year 2000. Nucleic Acids Res. Jan. 1, 2000;28(1):292. doi: 10.1093/nar/28.1.292.

Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.

Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.

Navaratnam et al., An overview of cytidine deaminases. Int J Hematol. Apr. 2006;83(3):195-200.

NCBI Reference Sequence: NM_002427.3. Wu et al., May 3, 2014. 5 pages.

Neel et al., Riboswitches: Classification, function and in silico approach, International Journal of Pharma Sciences and Research. 2010;1(9):409-420.

Nelson et al., Filamentous phage DNA cloning vectors: a noninfective mutant with a nonpolar deletion in gene III. Virology. 1981;108(2): 338-50.

Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.

Nelson et al., The unstable repeats—three evolving faces of neurological disease. Neuron. Mar. 6, 2013;77(5):825-43. doi: 10.1016/j.neuron.2013.02.022.

Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.

Newby et al., Base editing of haematopoietic stem cells rescues sickle cell disease in mice. Nature. Jun. 2, 2021. doi: 10.1038/s41586-021-03609-w. Epub ahead of print.

Nguyen et al., Evolutionary drivers of thermoadaptation in enzyme catalysis. Science. Jan. 20, 2017;355(6322):289-294. doi: 10.1126/science.aah3717. Epub Dec. 22, 2016.

Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.

Ni et al., A PCSK9-binding antibody that structurally mimics the EGF(A) domain of LDL-receptor reduces LDL cholesterol in vivo. J Lipid Res. 2011;52:76-86.

Ni et al., Nucleic acid aptamers: clinical applications and promising new horizons. Curr Med Chem. 2011;18(27):4206-14. Review.

Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.

Nishikura, Functions and regulation of RNA editing by ADAR deaminases. Annu Rev Biochem. 2010;79:321-349. doi:10.1146/annurev-biochem-060208-105251.

Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.

Nishimasu et al., Crystal Structure of *Staphylococcus aureus* Cas9. Cell. Aug. 27, 2015;162(5):1113-26. doi: 10.1016/j.cell.2015.08.007.

Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.

Noack et al., Epitranscriptomics: A New Regulatory Mechanism of Brain Development and Function. Front Neurosci. Feb. 20, 2018;12:85. doi: 10.3389/fnins.2018.00085. 9 pages.

Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.

Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.

(56) References Cited

OTHER PUBLICATIONS

Noris et al., A phenylalanine-55 to serine amino-acid substitution in the human glycoprotein IX leucine-rich repeat is associated with Bernard-Soulier syndrome. Br J Haematol. May 1997;97(2):312-20.

Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.

Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.

Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.

Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.

Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.

O'Connell et al., Programmable RNA recognition and cleavage by CRISPR/Cas9. Nature. Dec. 11, 2014;516(7530):263-6. doi: 10.1038/nature13769. Epub Sep. 28, 2014.

O'Maille et al., Structure-based combinatorial protein engineering (SCOPE). J Mol Biol. Aug. 23, 2002;321(4):677-91.

Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.

Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.

Oakes et al., Protein engineering of Cas9 for enhanced function. Methods Enzymol. 2014;546:491-511.

Odsbu et al., Specific N-terminal interactions of the *Escherichia coli* SeqA protein are required to form multimers that restrain negative supercoils and form foci. Genes Cells. Nov. 2005;10(11):1039-49.

Oeemig et al., Solution structure of DnaE intein from Nostoc punctiforme: structural basis for the design of a new split intein suitable for site-specific chemical modification. FEBS Lett. May 6, 2009;583(9):1451-6.

Offord, Advances in Genome Editing. The Scientist, Apr. 20, 2016. http://www.the-scientist.com/?articles.view/articleNo/45903/title/Advances-in-Genome-Editing/.

Oh et al., Positional cloning of a gene for Hermansky-Pudlak syndrome, a disorder of cytoplasmic organelles. Nat Genet. Nov. 1996;14(3):300-6. doi: 10.1038/ng1196-300.

Ohe et al., Purification and properties of xanthine dehydrogenase from Streptomyces cyanogenus. J Biochem. Jul. 1979;86(1):45-53.

Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.

Olorunniji et al., Purification and In Vitro Characterization of Zinc Finger Recombinases. Methods Mol Biol. 2017;1642:229-245. doi: 10.1007/978-1-4939-7169-5_15.

Olorunniji et al., Site-specific recombinases: molecular machines for the Genetic Revolution. Biochem J. Mar. 15, 2016;473(6):673-84. doi: 10.1042/BJ20151112.

Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.

Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.

Orthwein et al., A mechanism for the suppression of homologous recombination in G1 cells. Nature. Dec. 17, 2015;528(7582):422-6. doi: 10.1038/nature16142. Epub Dec. 9, 2015.

Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.

Osborn et al., TALEN-based gene correction for epidermolysis bullosa. Mol Ther. Jun. 2013;21(6):1151-9. doi: 10.1038/mt.2013.56. Epub Apr. 2, 2013.

Ostermeier et al., A combinatorial approach to hybrid enzymes independent of DNA homology. Nat Biotechnol. Dec. 1999;17(12):1205-9.

Ostertag et al., Biology of mammalian L1 retrotransposons. Annu Rev Genet. 2001;35:501-38. doi: 10.1146/annurev.genet.35.102401.091032.

Otomo et al., Improved segmental isotope labeling of proteins and application to a larger protein. J Biomol NMR. Jun. 1999;14(2):105-14. doi: 10.1023/a:1008308128050.

Otomo et al., NMR observation of selected segments in a larger protein: central-segment isotope labeling through intein-mediated ligation. Biochemistry. Dec. 7, 1999;38(49):16040-4. doi: 10.1021/bi991902j.

Ottesen, ISS-N1 makes the First FDA-approved Drug for Spinal Muscular Atrophy. Transl Neurosci. Jan. 26, 2017;8:1-6. doi: 10.1515/tnsci-2017-0001.

Otto et al., The probability of fixation in populations of changing size. Genetics. Jun. 1997;146(2):723-33.

Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.

Pabo et al., Design and selection of novel Cys2His2 zinc finger proteins. Annu Rev Biochem. 2001;70:313-40.

Packer et al., Methods for the directed evolution of proteins. Nat Rev Genet. Jul. 2015;16(7):379-94. doi: 10.1038/nrg3927. Epub Jun. 9, 2015.

Packer et al., Phage-assisted continuous evolution of proteases with altered substrate specificity. Nat Commun. Oct. 16, 2017;8(1):956. doi: 10.1038/s41467-017-01055-9.

Paige et al., RNA mimics of green fluorescent protein. Science. Jul. 29, 2011;333(6042):642-6. doi:10.1126/science.1207339.

Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.

Pan et al., Biological and biomedical applications of engineered nucleases. Mol Biotechnol. Sep. 2013;55(1):54-62. doi: 10.1007/s12033-012-9613-9.

Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.

Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.

Parente et al., Advances in spinal muscular atrophy therapeutics. Ther Adv Neurol Disord. Feb. 5, 2018;11:1756285618754501. doi: 10.1177/1756285618754501. 13 pages.

Park et al., Digenome-seq web tool for profiling CRISPR specificity. Nat Methods. May 30, 2017;14(6):548-549. doi: 10.1038/nmeth.4262.

Park et al., Highly efficient editing of the ?- globin gene in patient-derived hematopoietic stem and progenitor cells to treat sickle cell disease. Nucleic Acids Res. Sep. 5, 2019;47(15):7955-7972. doi: 10.1093/nar/gkz475.

Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.

(56) References Cited

OTHER PUBLICATIONS

Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Parsons et al., Hypermutability and mismatch repair deficiency in RER+ tumor cells. Cell. Dec. 17, 1993;75(6):1227-36. doi: 10.1016/0092-8674(93)90331-j.
Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.
Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pendse et al., In Vivo Assessment of Potential Therapeutic Approaches for USH2A-Associated Diseases. Adv Exp Med Biol. 2019;1185:91-96. doi: 10.1007/978-3-030-27378-1_15.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.
Perez-Pinera et al., Advances in targeted genome editing. Curr Opin Chem Biol. Aug. 2012; 16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Perreault et al., Mixed deoxyribo- and ribo-oligonucleotides with catalytic activity. Nature. Apr. 5, 1990;344(6266):565-7. doi: 10.1038/344565a0.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates E. coli suggesting a DNA deamination mechanism for antibody diversification. Nature. Jul. 4, 2002;418(6893):99-103.
Petit et al., Powerful mutators lurking in the genome. Philos Trans R Soc Lond B Biol Sci. Mar. 12, 2009;364(1517):705-15. doi: 10.1098/rstb.2008.0272.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Pham et al., Reward versus risk: DNA cytidine deaminases triggering immunity and disease. Biochemistry. Mar. 1, 2005;44(8):2703-15.
Phillips, The challenge of gene therapy and DNA delivery. J Pharm Pharmacol. Sep. 2001;53(9):1169-74.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pieken et al., Kinetic characterization of ribonuclease-resistant 2'-modified hammerhead ribozymes. Science. Jul. 19, 1991;253(5017):314-7. doi: 10.1126/science.1857967.
Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of Escherichia coli and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Plotz et al., N-terminus of hMLH1 confers interaction of hMutLalpha and hMutLbeta with hMutSalpha. Nucleic Acids Res. Jun. 15, 2003;31(12):3217-26. doi: 10.1093/nar/gkg420.
Pluciennik et al., PCNA function in the activation and strand direction of MutLα endonuclease in mismatch repair. Proc Natl Acad Sci U S A. Sep. 14, 2010;107(37):16066-71. doi: 10.1073/pnas.1010662107. Epub Aug. 16, 2010.

(56) References Cited

OTHER PUBLICATIONS

Poller et al., A leucine-to-proline substitution causes a defective alpha 1-antichymotrypsin allele associated with familial obstructive lung disease. Genomics. Sep. 1993;17(3):740-3.

Popp et al., Sortagging: a versatile method for protein labeling. Nat Chem Biol. Nov. 2007;3(11):707-8. doi: 10.1038/nchembio.2007.31. Epub Sep. 23, 2007.

Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.

Porteus, Design and testing of zinc finger nucleases for use in mammalian cells. Methods Mol Biol. 2008;435:47-61. doi: 10.1007/978-1-59745-232-8_4.

Posnick et al., Imbalanced base excision repair increases spontaneous mutation and alkylation sensitivity in *Escherichia coli*. J Bacteriol. Nov. 1999;181(21):6763-71.

Pospísilová et al., Hydrolytic cleavage of N6-substituted adenine derivatives by eukaryotic adenine and adenosine deaminases. Biosci Rep. 2008;28(6):335-347. doi:10.1042/BSR20080081.

Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.

Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.

Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.

Prashant et al., CAS9 transcriptional activators for target specificity screening and paired nickases for cooperative genome engineering. Nature Biotechnology 2013;31(9):833-8.

Prorocic et al., Zinc-finger recombinase activities in vitro. Nucleic Acids Res. Nov. 2011;39(21):9316-28. doi: 10.1093/nar/gkr652. Epub Aug. 17, 2011.

Proudfoot et al., Zinc finger recombinases with adaptable DNA sequence specificity. PLoS One. Apr. 29, 2011;6(4):e19537. doi: 10.1371/journal.pone.0019537.

Pruschy et al., Mechanistic studies of a signaling pathway activated by the organic dimerizer FK1012. Chem Biol. Nov. 1994;1(3):163-72. doi: 10.1016/1074-5521(94)90006-x.

Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.

Pu et al., Evolution of a split RNA polymerase as a versatile biosensor platform. Nat Chem Biol. Apr. 2017;13(4):432-438. doi: 10.1038/nchembio.2299. Epub Feb. 13, 2017.

Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.

Putney et al., Improving protein therapeutics with sustained-release formulations. Nat Biotechnol. Feb. 1998;16(2):153-7.

Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.

Qi et al., Repurposing CRISPR as an RNA-guided platform for sequence-specific control of gene expression. Cell. Feb. 28, 2013;152(5):1173-83. doi: 10.1016/j.cell.2013.02.022.

Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.

Queen et al., Immunoglobulin gene transcription is activated by downstream sequence elements. Cell. Jul. 1983;33(3):741-8. doi: 10.1016/0092-8674(83)90016-8.

Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.

Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.

Raillard et al., Targeting sites within HIV-1 cDNA with a DNA-cleaving ribozyme. Biochemistry. Sep. 10, 1996;35(36):11693-701. doi: 10.1021/bi960845g.

Raina et al., Protac-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.

Rajagopal et al., High-throughput mapping of regulatory DNA. Nat Biotechnol. Feb. 2016;34(2):167-74. doi: 10.1038/nbt.3468. Epub Jan. 25, 2016.

Rakonjac et al., Roles of PIII in filamentous phage assembly. J Mol Biol. 1998; 282(1)25-41.

Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.

Ramamurthy et al., Identification of immunogenic B-cell epitope peptides of rubella virus E1 glycoprotein towards development of highly specific immunoassays and/or vaccine. Conference Abstract. 2019.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.

Ran et al., Genome engineering using the CRISPR-Cas9 system. Nat Protoc. Nov. 2013;8(11):2281-308. doi: 10.1038/nprot.2013.143. Epub Oct. 24, 2013.

Ran et al., In vivo genome editing using *Staphylococcus aureus* Cas9. Nature. Apr. 9, 2015;520(7546):186-91. doi: 10.1038/nature14299. Epub Apr. 1, 2015.

Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.

Räschle et al., Mutations within the hMLH1 and hPMS2 subunits of the human MutLalpha mismatch repair factor affect its ATPase activity, but not its ability to interact with hMutSalpha. J Biol Chem. Jun. 14, 2002;277(24):21810-20. doi: 10.1074/jbc.M108787200. Epub Apr. 10, 2002.

Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.

Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.

Raskin et al., Substitution of a single bacteriophage T3 residue in bacteriophage T7 RNA polymerase at position 748 results in a switch in promoter specificity. J Mol Biol. Nov. 20, 1992;228(2):506-15.

Raskin et al., T7 RNA polymerase mutants with altered promoter specificities. Proc Natl Acad Sci U S A. Apr. 15, 1993;90(8):3147-51.

Rath et al., Fidelity of end joining in mammalian episomes and the impact of Metnase on joint processing. BMC Mol Biol. Mar. 22, 2014;15:6. doi: 10.1186/1471-2199-15-6.

(56) References Cited

OTHER PUBLICATIONS

Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Ray et al., A compendium of RNA-binding motifs for decoding gene regulation. Nature. Jul. 11, 2013;499(7457):172-7. doi: 10.1038/nature12311.
Ray et al., Homologous recombination: ends as the means. Trends Plant Sci. Oct. 2002;7(10):435-40.
Rebar et al., Phage display methods for selecting zinc finger proteins with novel DNA-binding specificities. Methods Enzymol. 1996;267:129-49.
Rebuzzini et al., New mammalian cellular systems to study mutations introduced at the break site by non-homologous end-joining. DNA Repair (Amst). May 2, 2005;4(5):546-55.
Rees et al., Analysis and minimization of cellular RNA editing by DNA adenine base editors. Sci Adv. May 8, 2019;5(5):eaax5717. doi: 10.1126/sciadv.aax5717.
Rees et al., Base editing: precision chemistry on the genome and transcriptome of living cells. Nat Rev Genet. Dec. 2018;19(12):770-788. doi: 10.1038/s41576-018-0059-1.
Rees et al., Development of hRad51-Cas9 nickase fusions that mediate HDR without double-stranded breaks. Nat Commun. May 17, 2019;10(1):2212. doi: 10.1038/s41467-019-09983-4.
Rees et al., Improving the DNA specificity and applicability of base editing through protein engineering and protein delivery. Nat Commun. Jun. 6, 2017;8:15790. doi: 10.1038/ncomms15790.
Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.
Relph et al., Recent developments and current status of gene therapy using viral vectors in the United Kingdom. BMJ. 2004;329(7470):839-842. doi:10.1136/bmj.329.7470.839.
Remy et al., Gene transfer with a series of lipophilic DNA-binding molecules. Bioconjug Chem. Nov.-Dec. 1994;5(6):647-54. doi: 10.1021/bc00030a021.
Ren et al., In-line Alignment and $Mg^{2+}$ Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Reynaud et al., What role for AID: mutator, or assembler of the immunoglobulin mutasome? Nat Immunol. Jul. 2003;4(7):631-8.
Reyon et al., FLASH assembly of TALENs for high-throughput genome editing. Nat Biotechnol. May 2012;30(5):460-5. doi: 10.1038/nbt.2170.
Ribeiro et al., Protein Engineering Strategies to Expand CRISPR-Cas9 Applications. Int J Genomics. Aug. 2, 2018;2018:1652567. doi: 10.1155/2018/1652567.
Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Richardson et al., Frequent chromosomal translocations induced by DNA double-strand breaks. Nature. Jun. 8, 2000;405(6787):697-700. doi: 10.1038/35015097.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Riechmann et al., The C-terminal domain of To1A is the coreceptor for filamentous phage infection of *E. coli*. Cell. 1997; 90(2):351-60. PMID:9244308.
Ringrose et al., The Kw recombinase, an integrase from Kluyveromyces waltii. Eur J Biochem. Sep. 15, 1997;248(3):903-12. doi: 10.1111/j.1432-1033.1997.00903.x.
Risso et al., Hyperstability and substrate promiscuity in laboratory resurrections of Precambrian β-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Rizk et al., An engineered substance P variant for receptor-mediated delivery of synthetic antibodies into tumor cells. Proc Natl Acad Sci U S A. Jul. 7, 2009;106(27):11011-5. doi: 10.1073/pnas.0904907106. Epub Jun. 22, 2009.
Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.
Robertson et al., DNA repair in mammalian cells: Base excision repair: the long and short of it. Cell Mol Life Sci. Mar. 2009;66(6):981-93. doi: 10.1007/s00018-009-8736-z.
Robertson et al., Selection in vitro of an RNA enzyme that specifically cleaves single-stranded DNA. Nature. Mar. 29, 1990;344(6265):467-8. doi: 10.1038/344467a0.
Robinson et al., The protein tyrosine kinase family of the human genome. Oncogene. Nov. 20, 2000;19(49):5548-57. doi: 10.1038/sj.onc.1203957.
Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A riboswitch selective for the queuosine precursor preQ1 contains an unusually small aptamer domain. Nat Struct Mol Biol. Apr. 2007;14(4):308-17. Epub Mar. 25, 2007.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.

(56) References Cited

OTHER PUBLICATIONS

Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Rüfer et al., Non-contact positions impose site selectivity on Cre recombinase. Nucleic Acids Res. Jul. 1, 2002;30(13):2764-71. doi: 10.1093/nar/gkf399.
Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.
Sadelain et al., Safe harbours for the integration of new DNA in the human genome. Nat Rev Cancer. Dec. 1, 2011;12(1):51-8. doi: 10.1038/nrc3179.
Sadowski, The Flp recombinase of the 2-microns plasmid of *Saccharomyces cerevisiae*. Prog Nucleic Acid Res Mol Biol. 1995;51:53-91.
Safari et al., CRISPR Cpf1 proteins: structure, function and implications for genome editing. Cell Biosci. May 9, 2019;9:36. doi: 10.1186/s13578-019-0298-7.
Sage et al., Proliferation of functional hair cells in vivo in the absence of the retinoblastoma protein. Science. Feb. 18, 2005;307(5712):1114-8. Epub Jan. 13, 2005.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samanta et al., A reverse transcriptase ribozyme. Elife. Sep. 26, 2017;6:e31153. doi: 10.7554/eLife.31153.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
San Filippo et al., Mechanism of eukaryotic homologous recombination. Annu Rev Biochem. 2008;77:229-57. doi: 10.1146/annurev.biochem.77.061306.125255.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.
Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Sasidharan et al., The selection of acceptable protein mutations. PNAS; Jun. 12, 2007;104(24):10080-5. www.pnas.org/cgi/doi/10.1073.pnas.0703737104.
Satomura et al., Precise genome-wide base editing by the CRISPR Nickase system in yeast. Sci Rep. May 18, 2017;7(1):2095. doi: 10.1038/s41598-017-02013-7.
Saudek et al., A preliminary trial of the programmable implantable medication system for insulin delivery. N Engl J Med. Aug. 31, 1989;321(9):574-9.
Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Savva et al., The structural basis of specific base-excision repair by uracil-DNA glycosylase. Nature. Feb. 9, 1995;373(6514):487-93. doi: 10.1038/373487a0.
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR-Display. Nat Methods. Jul. 2015;12(7):664-70.

(56) References Cited

OTHER PUBLICATIONS doi: 10.1038/nmeth.3433. Epub Jun. 1, 2015. Author manuscript entitled CRISPR Display: A modular method for locus-specific targeting of long noncoding RNAs and synthetic RNA devices in vivo.
Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.
Schenk et al., MPDU1 mutations underlie a novel human congenital disorder of glycosylation, designated type If. J Clin Invest. Dec. 2001;108(11):1687-95. doi: 10.1172/JCI13419.
Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.
Schmitz et al., Behavioral abnormalities in prion protein knockout mice and the potential relevance of PrP(C) for the cytoskeleton. Prion. 2014;8(6):381-6. doi: 10.4161/19336896.2014.983746.
Schrank et al., Inactivation of the survival motor neuron gene, a candidate gene for human spinal muscular atrophy, leads to massive cell death in early mouse embryos. Proc Natl Acad Sci U S A. Sep. 2, 1997;94(18):9920-5. doi: 10.1073/pnas.94.18.9920.
Schriefer et al., Low pressure DNA shearing: a method for random DNA sequence analysis. Nucleic Acids Res. Dec. 25, 1990;18(24):7455-6.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., Oligo-2'-fluoro-2'-deoxynucleotide N3'-->P5' phosphoramidates: synthesis and properties. Nucleic Acids Res. Aug. 1, 1996;24(15):2966-73.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.
Sclimenti et al., Directed evolution of a recombinase for improved genomic integration at a native human sequence. Nucleic Acids Res. Dec. 15, 2001;29(24):5044-51.
Score Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.
Score Results for Okumura et al., Evolutionary paths of streptococcal and staphylococcal superantigens. RL BMC Genomics. 2012;13:404-404. 3 pages.
Score Results for Shimomura et al., Complete Genome Sequencing and Analysis of a Lancefield Group G RT *Streptococcus dysagalactiae* Subsp. Equisimilis Strain Causing Streptococcal RT Toxic Shock Syndrome (STSS). RL BMC Genomics. 2011;12:17-17. 3 pages.
Scott et al., Production of cyclic peptides and proteins in vivo. Proc Natl Acad Sci U S A. Nov. 23, 1999;96(24):13638-43. doi: 10.1073/pnas.96.24.13638.
Sebastían-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29, 1987-Nov. 4;329(6142):840-2. doi: 10.1038/329840a0.

Sefton et al., Implantable pumps. Crit Rev Biomed Eng. 1987;14(3):201-40.
Segal et al., Evaluation of a modular strategy for the construction of novel polydactyl zinc finger DNA-binding proteins. Biochemistry. Feb. 25, 2003;42(7):2137-48.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.
Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Setten et al., The current state and future directions of RNAi-based therapeutics. Nat Rev Drug Discov. Jun. 2019;18(6):421-446. doi: 10.1038/s41573-019-0017-4.
Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shaikh et al., Chimeras of the Flp and Cre recombinases: tests of the mode of cleavage by Flp and Cre. J Mol Biol. Sep. 8, 2000;302(1):27-48.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Shalem et al., High-throughput functional genomics using CRISPR-Cas9. Nat Rev Genet. May 2015;16(5):299-311. doi: 10.1038/nrg3899. Epub Apr. 9, 2015.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharma et al., Identification of novel methyltransferases, Bmt5 and Bmt6, responsible for the m3U methylations of 25S rRNA in

(56) References Cited

OTHER PUBLICATIONS

Saccharomyces cerevisiae. Nucleic Acids Res. Mar. 2014;42(5):3246-60. doi: 10.1093/nar/gkt1281. Epub Dec. 11, 2013.

Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.

Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.

Shcherbakova et al., Mutator phenotypes conferred by MLH1 overexpression and by heterozygosity for mlh1 mutations. Mol Cell Biol. Apr. 1999;19(4):3177-83. doi: 10.1128/MCB.19.4.3177.

Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.

Shechner et al., Multiplexable, locus-specific targeting of long RNAs with CRISPR-Display. Nat Methods. Jul. 2015;12(7):664-70. doi: 10.1038/nmeth.3433. Epub Jun. 1, 2015.

Shee et al., Engineered proteins detect spontaneous DNA breakage in human and bacterial cells. Elife. Oct. 29, 2013;2:e01222. doi: 10.7554/eLife.01222.

Shen et al., Efficient genome modification by CRISPR-Cas9 nickase with minimal off-target effects. Nat Methods. Apr. 2014;11(4):399-402. doi: 10.1038/nmeth.2857. Epub Mar. 2, 2014.

Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.

Shen et al., Predictable and precise template-free CRISPR editing of pathogenic variants. Nature. Nov. 2018;563(7733):646-651. doi: 10.1038/s41586-018-0686-x. Epub Nov. 7, 2018.

Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.

Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.

Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.

Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.

Shimizu et al., Adding fingers to an engineered zinc finger nuclease can reduce activity. Biochemistry. Jun. 7, 2011;50(22):5033-41. doi: 10.1021/bi200393g. Epub May 11, 2011.

Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.

Shin et al., CRISPR/Cas9 targeting events cause complex deletions and insertions at 17 sites in the mouse genome. Nat Commun. May 31, 2017;8:15464. doi: 10.1038/ncomms15464.

Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.

Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.

Shmakov et al., Discovery and Functional Characterization of Diverse Class 2 CRISPR Cas Systems. Molecular Cell Nov. 2015;60(3):385-97.

Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.

Shultz et al., A genome-wide analysis of FRT-like sequences in the human genome. PLoS One. Mar. 23, 2011;6(3):e18077. doi: 10.1371/journal.pone.0018077.

Siebert et al., An improved PCR method for walking in uncloned genomic DNA. Nucleic Acids Res. Mar. 25, 1995;23(6):1087-8.

Silas et al., Direct CRISPR spacer acquisition from RNA by a natural reverse transcriptase-Cas1 fusion protein. Science. Feb. 26, 2016;351(6276):aad4234. doi: 10.1126/science.aad4234.

Silva et al., Selective disruption of the DNA polymerase III $\alpha$-$\beta$ complex by the umuD gene products. Nucleic Acids Res. Jul. 2012;40(12):5511-22. doi: 10.1093/nar/gks229. Epub Mar. 9, 2012.

Simonelli et al., Base excision repair intermediates are mutagenic in mammalian cells. Nucleic Acids Res. Aug. 2, 2005;33(14):4404-11. Print 2005.

Singh et al., Cross-talk between diverse serine integrases. J Mol Biol. Jan. 23, 2014;426(2):318-31. doi: 10.1016/j.jmb.2013.10.013. Epub Oct. 22, 2013.

Singh et al., Real-time observation of DNA recognition and rejection by the RNA-guided endonuclease Cas9. Nat Commun. Sep. 14, 2016;7:12778. doi: 10.1038/ncomms12778.

Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.

Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.

Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.

Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.

Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.

Sjoblom et al., The consensus coding sequences of human breast and colorectal cancers. Science. Oct. 13, 2006;314(5797):268-74. Epub Sep. 7, 2006.

Skretas et al., Regulation of protein activity with small-molecule-controlled inteins. Protein Sci. Feb. 2005;14(2):523-32. Epub Jan. 4, 2005.

Slaymaker et al., Rationally engineered Cas9 nucleases with improved specificity. Science. Jan. 1, 2016;351(6268):84-8. doi: 10.1126/science.aad5227. Epub Dec. 1, 2015.

Sledz et al., Structural insights into the molecular mechanism of the m(6)A writer complex. Elife. Sep. 14, 2016;5:e18434. doi: 10.7554/eLife.18434.

Slupphaug et al., A nucleotide-flipping mechanism from the structure of human uracil-DNA glycosylase bound to DNA. Nature. Nov. 7, 1996;384(6604):87-92. doi: 10.1038/384087a0.

Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.

Smith et al., Diversity in the serine recombinases. Mol Microbiol. Apr. 2002;44(2):299-307. Review.

Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.

(56) References Cited

OTHER PUBLICATIONS

Smith et al., Herpesvirus transport to the nervous system and back again. Annu Rev Microbiol. 2012;66:153-76. doi: 10.1146/annurev-micro-092611-150051. Epub Jun. 15, 2012.

Smith et al., Production of human beta interferon in insect cells infected with a baculovirus expression vector. Mol Cell Biol. Dec. 1983;3(12):2156-65. doi: 10.1128/mcb.3.12.2156.

Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.

Smith, Filamentous fusion phage: novel expression vectors that display cloned antigens on the virion surface. Science. Jun. 14, 1985;228(4705):1315-7.

Smith, Phage-encoded Serine Integrases and Other Large Serine Recombinases. Microbiol Spectr. Aug. 2015;3(4). doi: 10.1128/microbiolspec.MDNA3-0059-2014.

Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.

Sommerfelt et al., Receptor interference groups of 20 retroviruses plating on human cells. Virology. May 1990;176(1):58-69. doi: 10.1016/0042-6822(90)90230-o.

Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.

Song et al., Antibody mediated in vivo delivery of small interfering RNAs via cell-surface receptors. Nat Biotechnol. Jun. 2005;23(6):709-17. Epub May 22, 2005.

Song et al., RS-1 enhances CRISPR/Cas9- and TALEN-mediated knock-in efficiency. Nat Commun. Jan. 28, 2016;7:10548. doi: 10.1038/ncomms10548.

Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.

Southworth et al., Control of protein splicing by intein fragment reassembly. EMBO J. Feb. 16, 1998;17(4):918-26. doi: 10.1093/emboj/17.4.918.

Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.

Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.

Spencer et al., Controlling signal transduction with synthetic ligands. Science. Nov. 12, 1993;262(5136):1019-24. doi: 10.1126/science.7694365.

Spencer et al., Functional analysis of Fas signaling in vivo using synthetic inducers of dimerization. Curr Biol. Jul. 1, 1996;6(7):839-47. doi: 10.1016/s0960-9822(02)00607-3.

Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.

Stadtman, Selenocysteine. Annu Rev Biochem. 1996;65:83-100.

Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.

Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.

Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.

Steele et al., The prion protein knockout mouse: a phenotype under challenge. Prion. Apr.-Jun. 2007;1(2):83-93. doi: 10.4161/pri.1.2.4346. Epub Apr. 25, 2007.

Steiner et al., The neurotropic herpes viruses: herpes simplex and varicella-zoster. Lancet Neurol. Nov. 2007;6(11):1015-28. doi: 10.1016/S1474-4422(07)70267-3.

Stella et al., Structure of the Cpf1 endonuclease R-loop complex after target DNA cleavage. Nature. Jun. 22, 2017;546(7659):559-563. doi: 10.1038/nature22398. Epub May 31, 2017.

Stenglein et al., APOBEC3 proteins mediate the clearance of foreign DNA from human cells. Nat Struct Mol Biol. Feb. 2010;17(2):222-9. doi: 10.1038/nsmb.1744. Epub Jan. 10, 2010.

Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.

Stephens et al., The landscape of cancer genes and mutational processes in breast cancer. Nature Jun. 2012;486:400-404. doi:10.1038/nature11017.

Sternberg et al., Conformational control of DNA target cleavage by CRISPR-Cas9. Nature. Nov. 5, 2015;527(7576):110-3. doi: 10.1038/nature15544. Epub Oct. 28, 2015.

Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.

Sterne-Weiler et al., Exon identity crisis: disease-causing mutations that disrupt the splicing code. Genome Biol. Jan. 23, 2014;15(1):201. doi: 10.1186/gb4150.

Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.

Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.

Strand et al., Destabilization of tracts of simple repetitive DNA in yeast by mutations affecting DNA mismatch repair. Nature. Sep. 16, 1993;365(6443):274-6. doi: 10.1038/365274a0. Erratum in: Nature Apr. 7, 1994;368(6471);569.

Strecker et al., Engineering of CRISPR-Cas12b for human genome editing. Nat Commun. Jan. 22, 2019;10(1):212. doi: 10.1038/s41467-018-08224-4.

Strecker et al., RNA-guided DNA insertion with CRISPR-associated transposases. Science. Jul. 5, 2019;365(6448):48-53. doi: 10.1126/science.aax9181. Epub Jun. 6, 2019.

Strutt et al., RNA-dependent RNA targeting by CRISPR-Cas9. Elife. Jan. 5, 2018;7:e32724. doi: 10.7554/eLife.32724.

Su et al., Human DNA polymerase η has reverse transcriptase activity in cellular environments. J Biol Chem. Apr. 12, 2019;294(15):6073-6081. doi: 10.1074/jbc.RA119.007925. Epub Mar. 6, 2019.

Su et al., Mispair specificity of methyl-directed DNA mismatch correction in vitro. J Biol Chem. May 15, 1988;263(14):6829-35. Erratum in: J Biol Chem Aug. 5, 1988;263(22):11015.

Sudarsan et al., An mRNA structure in bacteria that controls gene expression by binding lysine. Genes Dev. Nov. 1, 2003;17(21):2688-97.

Sudarsan et al., Riboswitches in eubacteria sense the second messenger cyclic di-GMP. Science. Jul. 18, 2008;321(5887):411-3. doi: 10.1126/science.1159519.

Suess et al., A theophylline responsive riboswitch based on helix slipping controls gene expression in vivo. Nucleic Acids Res. Mar. 5, 2004;32(4):1610-4.

Sugawara et al., Heteroduplex rejection during single-strand annealing requires Sgs1 helicase and mismatch repair proteins Msh2 and Msh6 but not Pms1. Proc Natl Acad Sci U S A. Jun. 22, 2004;101(25):9315-20. doi: 10.1073/pnas.0305749101. Epub Jun. 15, 2004.

(56) References Cited

OTHER PUBLICATIONS

Sullenger et al., Ribozyme-mediated repair of defective mRNA by targeted, trans-splicing. Nature. Oct. 13, 1994;371(6498):619-22. doi: 10.1038/371619a0.
Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Supek et al., Differential DNA mismatch repair underlies mutation rate variation across the human genome. Nature. May 7, 2015;521(7550):81-4. doi: 10.1038/nature14173. Epub Feb. 23, 2015.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Svitashev et al., Targeted Mutagenesis, Precise Gene Editing, and Site-Specific Gene Insertion in Maize Using Cas9 and Guide RNA. Plant Physiol. Oct. 2015; 169(2):931-45. doi: 10.1104/pp.15.00793. Epub Aug. 12, 2015.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered; pyrrolysyl-tRNA synthetase and the efficient in vivo incorporation of; structurally divergent non-native amino acids. ACS Chem Biol. Jul. 2011; 15;6(7):733-43. doi: 10.1021/cb200057a. Epub May 5, 2011.
Talbot et al., Spinal muscular atrophy. Semin Neurol. Jun. 2001;21(2):189-97. doi: 10.1055/s-2001-15264.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. N Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Teng et al., Mutational analysis of apolipoprotein B mRNA editing enzyme (APOBEC1). structure-function relationships of RNA editing and dimerization. J Lipid Res. Apr. 1999;40(4):623-35.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thomas et al., Heteroduplex repair in extracts of human HeLa cells. J Biol Chem. Feb. 25, 1991;266(6):3744-51.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12-396962-0.00012-4.
Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.

(56) References Cited

OTHER PUBLICATIONS

Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tomer et al., Contribution of human mlh1 and pms2 ATPase activities to DNA mismatch repair. J Biol Chem. Jun. 14, 2002;277(24):21801-9. doi: 10.1074/jbc.M111342200. Epub Mar. 15, 2002.
Tone et al., Single-stranded DNA binding protein Gp5 of Bacillus subtilis phage Φ29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1-associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tran et al., Hypermutability of homonucleotide runs in mismatch repair and DNA polymerase proofreading yeast mutants. Mol Cell Biol. May 1997;17(5):2859-65. doi: 10.1128/MCB.17.5.2859.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat β-hemoglobinopathies that recapitulates a mutation associated with a benign genetic condition. Nat Med. Sep. 2016;22(9):987-90. doi: 10.1038/nm.4170. Epub Aug. 15, 2016.

Trojan et al., Functional analysis of hMLH1 variants and HNPCC-related mutations using a human expression system. Gastroenterology. Jan. 2002;122(1):211-9. doi: 10.1053/gast.2002.30296.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., CIRCLE-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., Guide-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
Tyszkiewicz et al., Activation of protein splicing with light in yeast. Nat Methods. Apr. 2008;5(4):303-5. doi: 10.1038/nmeth.1189. Epub Feb. 13, 2008.
Umar et al., DNA loop repair by human cell extracts. Science. Nov. 4, 1994;266(5186):814-6. doi: 10.1126/science.7973637.
UniProt Consortium, UniProt: the universal protein knowledgebase. Nucleic Acids Res. Mar. 16, 2018;46(5):2699. doi: 10.1093/nar/gky092. Erratum for: Nucleic Acids Res. Jan. 4, 2017;45(D1):D158-D169.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
UniProtein A0A1V6. Dec. 11, 2019.
UniProtKB Submission; Accession No. F0NH53. May 3, 2011. 4 pages.
UniProtKB Submission; Accession No. F0NN87. May 3, 2011. 4 pages.
UniProtKB Submission; Accession No. G3ECR1.2. No Author Listed., Aug. 12, 2020, 8 pages.
UniProtKB Submission; Accession No. P04264. No Author Listed., Apr. 7, 2021. 12 pages.

(56) References Cited

OTHER PUBLICATIONS

UniProtKB Submission; Accession No. P0DOC6. No Author Listed., Oct. 5, 2016. 5 pages.
UniProtKBSubmission; Accession No. T0D7A2. Oct. 16, 2013. 10 pages.
UniProtKBSubmission; Accession No. U2UMQ6. No Author Listed., Apr. 7, 2021, 11 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Usman et al., Exploiting the chemical synthesis of RNA. Trends Biochem Sci. Sep. 1992;17(9):334-9. doi: 10.1016/0968-0004(92)90306-t.
Vagner et al., Efficiency of homologous DNA recombination varies along the Bacillus subtilis chromosome. J Bacteriol. Sep. 1988;170(9):3978-82.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (NY). 1988;6(10):1149-1154. doi: 10.1038/nbt1088-1149.
Van Den Oord et al., Pixel Recurrent Neural Networks. Proceedings of the 33rd International Conference on Machine Learning. Journal of Machine Learning Research. Aug. 19, 2016. vol. 48. 11 pages.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600102103. Epub Feb. 21, 2006.
Vasey et al., Phase I clinical and pharmacokinetic study of PK1 [N-(2-hydroxypropyl)methacrylamide copolymer doxorubicin]: first member of a new class of chemotherapeutic agents-drug-polymer conjugates. Cancer Research Campaign Phase I/II Committee.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.

Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Verma, The reverse transcriptase. Biochim Biophys Acta. Mar. 21, 1977;473(1):1-38. doi: 10.1016/0304-419x(77)90005-1.
Vidal et al., Yeast forward and reverse 'n'-hybrid systems. Nucleic Acids Res. Feb. 15, 1999;27(4):919-29. doi: 10.1093/nar/27.4.919.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol; Struct. 2006;35:225-49. Review.

(56) References Cited

OTHER PUBLICATIONS

Wang et al., Genetic screens in human cells using the CRISPR-Cas9 system. Science. Jan. 3, 2014;343(6166):80-4. doi: 10.1126/science.1246981. Epub Dec. 12, 2013.

Wang et al., Highly efficient CRISPR/HDR-mediated knock-in for mouse embryonic stem cells and zygotes. Biotechniques. 2015:59,201-2;204;206-8.

Wang et al., N(6)-methyladenosine Modulates Messenger RNA Translation Efficiency. Cell. Jun. 4, 2015;161(6):1388-99. doi: 10.1016/j.cell.2015.05.014.

Wang et al., N6-methyladenosine-dependent regulation of messenger RNA stability. Nature. Jan. 2, 2014;505(7481):117-20. doi: 10.1038/nature12730. Epub Nov. 27, 2013.

Wang et al., Neutralizing antibodies to therapeutic enzymes: considerations for testing, prevention and treatment. Nat Biotechnol. Aug. 2008;26(8):901-8. doi: 10.1038/nbt.1484.

Wang et al., Nucleation, propagation and cleavage of target RNAs in Ago silencing complexes. Nature. Oct. 8, 2009;461(7265):754-61. doi: 10.1038/nature08434.

Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.

Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.

Wang et al., Programming cells by multiplex genome engineering and accelerated evolution. Nature. Aug. 13, 2009;460(7257):894-8. Epub Jul. 26, 2009.

Wang et al., Reading RNA methylation codes through methyl-specific binding proteins. RNA Biol. 2014;11(6):669-72. doi: 10.4161/rna.28829. Epub Apr. 24, 2014.

Wang et al., Recombinase technology: applications and possibilities. Plant Cell Rep. Mar. 2011;30(3):267-85. doi: 10.1007/s00299-010-0938-1. Epub Oct. 24, 2010.

Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.

Wang et al., Staphylococcus aureus protein SAUGI acts as a uracil-DNA glycosylase inhibitor. Nucleic Acids Res. Jan. 2014;42(2):1354-64. doi: 10.1093/nar/gkt964. Epub Oct. 22, 2013.

Wang et al., Structural basis of N(6)-adenosine methylation by the METTL3-METTL14 complex. Nature. Jun. 23, 2016;534(7608):575-8. doi: 10.1038/nature18298. Epub May 25, 2016.

Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.

Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.

Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.

Warren et al., Mutations in the amino-terminal domain of lambda-integrase have differential effects on integrative and excisive recombination. Mol Microbiol. Feb. 2005;55(4):1104-12.

Warren et al., Structure of the human MutSalpha DNA lesion recognition complex. Mol Cell. May 25, 2007;26(4):579-92. doi: 10.1016/j.molcel.2007.04.018.

Watowich, The erythropoietin receptor: molecular structure and hematopoietic signaling pathways. J Investig Med. Oct. 2011;59(7):1067-72. doi: 10.2310/JIM.0b013e31820fb28c.

Waxman et al., Regulating excitability of peripheral afferents: emerging ion channel targets. Nat Neurosci. Feb. 2014;17(2):153-63. doi: 10.1038/nn.3602. Epub Jan. 28, 2014.

Weber et al., Assembly of designer TAL effectors by Golden Gate cloning. PLoS One. 2011;6(5):e19722. doi:10.1371/journal.pone.0019722. Epub May 19, 2011.

Weill et al., DNA polymerases in adaptive immunity. Nat Rev Immunol. Apr. 2008;8(4):302-12. doi: 10.1038/nri2281. Epub Mar. 14, 2008.

Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.

Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.

Weinberger et al., Disease-causing mutations C277R and C277Y modify gating of human C1C-1 chloride channels in myotonia congenita. J Physiol. Aug. 1, 2012;590(Pt 15):3449-64. doi: 0.1113/jphysiol.2012.232785. Epub May 28, 2012.

Weinert et al., Unbiased detection of CRISPR off-targets in vivo using Discover-Seq. Science. Apr. 19, 2019;364(6437):286-289. doi: 10.1126/science.aav9023. Epub Apr. 18, 2019.

Weiss et al., Loss-of-function mutations in sodium channel Nav1.7 cause anosmia. Nature. Apr. 14, 2011;472(7342):186-90. doi: 10.1038/nature09975. Epub Mar. 23, 2011.

Wen et al., Inclusion of a universal tetanus toxoid CD4(+) T cell epitope P2 significantly enhanced the immunogenicity of recombinant rotavirus ΔVP8* subunit parenteral vaccines. Vaccine. Jul. 31, 2014;32(35):4420-4427. doi: 10.1016/j.vaccine.2014.06.060. Epub Jun. 21, 2014.

West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.

Wharton et al., A new-specificity mutant of 434 repressor that defines an amino acid-base pair contact. Nature. Apr. 30-May 6, 1987;326(6116):888-91.

Wharton et al., Changing the binding specificity of a repressor by redesigning an alpha-helix. Nature. Aug. 15-21, 1985;316(6029):601-5.

Wheeler et al., The thermostability and specificity of ancient proteins. Curr Opin Struct Biol. Jun. 2016;38:37-43. doi: 10.1016/j.sbi.2016.05.015. Epub Jun. 9, 2016.

Wiedenheft et al., RNA-guided genetic silencing systems in bacteria and archaea. Nature. Feb. 15, 2012;482(7385):331-8. doi: 10.1038/nature10886. Review.

Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.

Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.

Wijnker et al., Managing meiotic recombination in plant breeding. Trends Plant Sci. Dec. 2008;13(12):640-6. doi: 10.1016/j.tplants.2008.09.004. Epub Oct. 22, 2008.

Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.

Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.

Wilson et al., Assessing annotation transfer for genomics: quantifying the relations between protein sequence, structure and function through traditional and probabilistic scores. J Mol Biol 2000;297:233-49.

Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.

Wilson et al., In Vitro Selection of Functional Nucleic Acids. Annu Rev Biochem. 1999;68:611-47. doi: 10.1146/annurev.biochem.68.1.611.

Wilson et al., Kinase dynamics. Using ancient protein kinases to unravel a modern cancer drug's mechanism. Science. Feb. 20, 2015;347(6224):882-6. doi: 10.1126/science.aaa1823.

(56) References Cited

OTHER PUBLICATIONS

Winkler et al., An mRNA structure that controls gene expression by binding FMN. Proc Natl Acad Sci U S A. Dec. 10, 2002;99(25):15908-13. Epub Nov. 27, 2002.
Winkler et al., An mRNA structure that controls gene expression by binding S-adenosylmethionine. Nat Struct Biol.Sep. 2003;10(9):701-7. Epub Aug. 10, 2003.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.
Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wirth et al., Mildly affected patients with spinal muscular atrophy are partially protected by an increased SMN2 copy number. Hum Genet. May 2006;119(4):422-8. doi: 10.1007/s00439-006-0156-7. Epub Mar. 1, 2006.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Wu et al., Widespread Influence of 3'-End Structures on Mammalian mRNA Processing and Stability. Cell. May 18, 2017;169(5):905-917.e11. doi: 10.1016/j.cell.2017.04.036.
Xi et al., C-terminal Loop Mutations Determine Folding and Secretion Properties of PCSK9. Biochem Mol Biol J. 2016;2(3):17. doi: 10.21767/2471-8084.100026. 12 pages.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ΦC31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. EMBO J. Oct. 1990;9(10):3353-62.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.
Xu et al., Protein splicing: an analysis of the branched intermediate and its resolution by succinimide formation. EMBO J. Dec. 1, 1994;13(23):5517-22.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121. /doi.org/10.1016/j.molcel.2017.02.007.
Yamamoto et al., The ons and offs of inducible transgenic technology: a review. Neurobiol Dis. Dec. 2001;8(6):923-32.

(56) References Cited

OTHER PUBLICATIONS

Yamamoto et al., Virological and immunological bases for HIV-1 vaccine design. Uirusu 2007;57(2):133-139. https://doi.org/10.2222/jsv.57.133.

Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.

Yamano et al., Crystal Structure of Cpf1 in Complex with Guide RNA and Target DNA. Cell May 2016;165(4)949-62.

Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.

Yamano et al., Crystal Structure of Cpf1 in Complex with Guide RNA and Target DNA. Cell. May 5, 2016;165(4):949-62. doi: 10.1016/j.cell.2016.04.003. Epub Apr. 21, 2016.

Yamazaki et al., Segmental Isotope Labeling for Protein NMR Using Peptide Splicing. J. Am. Chem. Soc. May 22, 1998; 120(22):5591-2. https://doi.org/10.1021/ja9807760.

Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.

Yan et al., Functionally diverse type V CRISPR-Cas systems. Science. Jan. 4, 2019;363(6422):88-91. doi: 10.1126/science.aav7271. Epub Dec. 6, 2018.

Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.

Yang et al., APOBEC: From mutator to editor. J Genet Genomics. Sep. 20, 2017;44(9):423-437. doi: 10.1016/j.jgg.2017.04.009. Epub Aug. 7, 2017.

Yang et al., BRCA2 function in DNA binding and recombination from a BRCA2-DSS1-ssDNA structure. Science. Sep. 13, 2002;297(5588):1837-48. doi: 10.1126/science.297.5588.1837.

Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.

Yang et al., Engineering and optimising deaminase fusions for genome editing. Nat Commun. Nov. 2, 2016;7:13330. doi: 10.1038/ncomms13330.

Yang et al., Genome editing with targeted deaminases. BioRxiv. Preprint. First posted online Jul. 28, 2016.

Yang et al., Genome-wide inactivation of porcine endogenous retroviruses (PERVs). Science. Nov. 27, 2015;350(6264):1101-4. doi: 10.1126/science.aad1191. Epub Oct. 11, 2015.

Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.

Yang et al., Mutations in SCN9A, encoding a sodium channel alpha subunit, in patients with primary erythermalgia. J Med Genet. Mar. 2004;41(3):171-4. doi: 10.1136/jmg.2003.012153.

Yang et al., New CRISPR-Cas systems discovered. Cell Res. Mar. 2017;27(3):313-314. doi: 10.1038/cr.2017.21. Epub Feb. 21, 2017.

Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.

Yang et al., PAM-dependent Target DNA Recognition and Cleavage by C2C1 CRISPR-Cas endonuclease. Cell Dec. 2016;167(7):1814-28.

Yang et al., Permanent genetic memory with >1-byte capacity. Nat Methods. Dec. 2014;11(12):1261-6. doi: 10.1038/nmeth.3147. Epub Oct. 26, 2014.

Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.

Yang et al., Small-molecule control of insulin and PDGF receptor signaling and the role of membrane attachment. Curr Biol. Jan. 1, 1998;8(1):11-8. doi: 10.1016/s0960-9822(98)70015-6.

Yang et al., The BRCA2 homologue Brh2 nucleates RAD51 filament formation at a dsDNA-ssDNA junction. Nature. Feb. 10, 2005;433(7026):653-7. doi: 10.1038/nature03234.

Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.

Yang, Nucleases: diversity of structure, function and mechanism. Q Rev Biophys. Feb. 2011;44(1):1-93. doi: 10.1017/S0033583510000181. Epub Sep. 21, 2010.

Yang, PAML 4: phylogenetic analysis by maximum likelihood. Mol Biol Evol. Aug. 2007;24(8):1586-91. doi: 10.1093/molbev/msm088. Epub May 4, 2007.

Yang, Phylogenetic Analysis by Maximum Likelihood (PAML). //abacus.gene.ucl.ac.uk/software/paml.html Last accessed Apr. 28, 2021.

Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.

Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.

Yasui, Alternative excision repair pathways. Cold Spring Harb Perspect Biol. Jun. 1, 2013;5(6):a012617. doi: 10.1101/cshperspect.a012617.

Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.

Yazaki et al., Hereditary systemic amyloidosis associated with a new apolipoprotein AII stop codon mutation Stop78Arg. Kidney Int. Jul. 2003;64(1):11-6.

Yeh et al., In vivo base editing of post-mitotic sensory cells. Nat Commun. Jun. 5, 2018;9(1):2184. doi: 10.1038/s41467-018-04580-3.

Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.

Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.

Yokoe et al., Spatial dynamics of GFP-tagged proteins investigated by local fluorescence enhancement. Nat Biotechnol. Oct. 1996;14(10):1252-6. doi: 10.1038/nbt1096-1252.

Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.

Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.

Yu et al., Dynamic control of Rad51 recombinase by self-association and interaction with BRCA2. Mol Cell. Oct. 2003;12(4):1029-41. doi: 10.1016/s1097-2765(03)00394-0.

Yu et al., Liposome-mediated in vivo E1A gene transfer suppressed dissemination of ovarian cancer cells that overexpress HER-2/neu. Oncogene. Oct. 5, 1995;11(7):1383-8.

Yu et al., Progress towards gene therapy for HIV infection. Gene Ther. Jan. 1994;1(1):13-26.

Yu et al., Small molecules enhance CRISPR genome editing in pluripotent stem cells. Cell Stem Cell. Feb. 5, 2015;16(2):142-7. doi: 10.1016/j.stem.2015.01.003.

(56) References Cited

OTHER PUBLICATIONS

Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.

Yuan et al., Laboratory-directed protein evolution. Microbiol Mol Biol Rev. 2005; 69(3):373-92. PMID: 16148303.

Yuan et al., Tetrameric structure of a serine integrase catalytic domain. Structure. Aug. 6, 2008;16(8):1275-86. doi: 10.1016/j.str.2008.04.018.

Yuen et al., Control of transcription factor activity and osteoblast differentiation in mammalian cells using an evolved small-molecule-dependent intein. J Am Chem Soc. Jul. 12, 2006;128(27):8939-46.

Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.

Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.

Zelphati et al., Intracellular delivery of proteins with a new lipid-mediated delivery system. J Biol Chem. Sep. 14, 2001;276(37):35103-10. Epub Jul. 10, 2001.

Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.

Zetsche et al., A split-Cas9 architecture for inducible genome editing and transcription modulation. Nat Biotechnol. Feb. 2015;33(2):139-42. doi: 10.1038/nbt.3149.

Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.

Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.

Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.

Zhang et al., Il-Clamp-mediated cysteine conjugation. Nat Chem. Feb. 2016;8(2):120-8. doi: 10.1038/nchem.2413. Epub Dec. 21, 2015.

Zhang et al., A new strategy for the site-specific modification of proteins in vivo. Biochemistry. Jun. 10, 2003;42(22):6735-46.

Zhang et al., Circular intronic long noncoding RNAs. Mol Cell. Sep. 26, 2013;51(6):792-806. doi: 10.1016/j.molcel.2013.08.017. Epub Sep. 12, 2013.

Zhang et al., Comparison of non-canonical PAMs for CRISPR/Cas9-mediated DNA cleavage in human cells. Sci Rep. Jun. 2014;4:5405.

Zhang et al., Conditional gene manipulation: Cre-ating a new biological era. J Zhejiang Univ Sci B. Jul. 2012;13(7):511-24. doi: 10.1631/jzus.B1200042. Review.

Zhang et al., Copy number variation in human health, disease, and evolution. Annu Rev Genomics Hum Genet. 2009;10:451-81. doi: 10.1146/annurev.genom.9.081307.164217.

Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.

Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.

Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.

Zhang et al., Global analysis of small RNA and mRNA targets of Hfq. Mol Microbiol. Nov. 2003;50(4):1111-24. doi: 10.1046/j.1365-2958.2003.03734.x.

Zhang et al., Large genomic fragment deletions and insertions in mouse using CRISPR/Cas9. PLoS One. Mar. 24, 2015;10(3):e0120396. doi: 10.1371/journal.pone.0120396. 14 pages.

Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.

Zhang et al., Programmable base editing of zebrafish genome using a modified CRISPR-Cas9 system. Nat Commun. Jul. 25, 2017;8(1):118. doi: 10.1038/s41467-017-00175-6.

Zhang et al., Reconstitution of 5'-directed human mismatch repair in a purified system. Cell. Sep. 9, 2005;122(5):693-705. doi: 10.1016/j.cell.2005.06.027.

Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.

Zhang et al., Ribozymes and Riboswitches: Modulation of RNA Function by Small Molecules. Biochemistry. Nov. 2, 2010;49(43):9123-31. doi: 10.1021/bi1012645.

Zhang et al., Stabilized plasmid-lipid particles for regional gene therapy: formulation and transfection properties. Gene Ther. Aug. 1999;6(8):1438-47.

Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.

Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.

Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.

Zheng et al., ALKBH5 is a mammalian RNA demethylase that impacts RNA metabolism and mouse fertility. Mol Cell. Jan. 10, 2013;49(1):18-29. doi: 10.1016/j.molcel.2012.10.015. Epub Nov. 21, 2012.

Zheng et al., DNA editing in DNA/RNA hybrids by adenosine deaminases that act on RNA. Nucleic Acids Res. Apr. 7, 2017;45(6):3369-3377. doi: 10.1093/nar/gkx050.

Zheng et al., Highly efficient base editing in bacteria using a Cas9-cytidine deaminase fusion. Commun Biol. Apr. 19, 2018;1:32. doi: 10.1038/s42003-018-0035-5.

Zheng et al., Structural basis for the complete resistance of the human prion protein mutant G127V to prion disease. Sci Rep. Sep. 4, 2018;8(1):13211. doi: 10.1038/s41598-018-31394-6.

Zhong et al., Rational Design of Aptazyme Riboswitches for Efficient Control of Gene Expression in Mammalian Cells. Elife. Nov. 2, 2016;5:e18858. doi: 10.7554/eLife.18858.

Zhou et al., Dynamic m(6)A mRNA methylation directs translational control of heat shock response. Nature. Oct. 22, 2015;526(7574):591-4. doi: 10.1038/nature15377. Epub Oct. 12, 2015.

Zhou et al., Generation of induced pluripotent stem cells using recombinant proteins. Cell Stem Cell. May 8, 2009;4(5):381-4. doi: 10.1016/j.stem.2009.04.005. Epub Apr. 23, 2009.

Zhou et al., GISSD: Group I Intron Sequence and Structure Database. Nucleic Acids Res. Jan. 2008;36(Database issue):D31-7. doi: 10.1093/nar/gkm766. Epub Oct. 16, 2007.

Zhou et al., Off-target RNA mutation induced by DNA base editing and its elimination by mutagenesis. Nature. Jul. 2019;571(7764):275-278. doi: 10.1038/s41586-019-1314-0. Epub Jun. 10, 2019.

Zhou et al., Protective V127 prion variant prevents prion disease by interrupting the formation of dimer and fibril from molecular dynamics simulations. Sci Rep. Feb. 24, 2016;6:21804. doi: 10.1038/srep21804.

Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.

Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA.116.308614. Epub Dec. 29, 2016.

(56) References Cited

OTHER PUBLICATIONS

Zielenski, Genotype and phenotype in cystic fibrosis. Respiration. 2000;67(2):117-33. doi: 10.1159/000029497.

Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.

Zimmerly et al., Group II intron mobility occurs by target DNA-primed reverse transcription. Cell. Aug. 25, 1995;82(4):545-54. doi: 10.1016/0092-8674(95)90027-6.

Zimmermann et al., Molecular interactions and metal binding in the theophylline-binding core of an RNA aptamer. RNA. May 2000;6(5):659-67.

Zolotukhin et al., Production and purification of serotype 1, 2, and 5 recombinant adeno-associated viral vectors. Methods. Oct. 2002;28(2):158-67. doi: 10.1016/s1046-2023(02)00220-7.

Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.

Zorko et al., Cell-penetrating peptides: mechanism and kinetics of cargo delivery. Adv Drug Deliv Rev. Feb. 28, 2005;57(4):529-45. Epub Jan. 22, 2005.

Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.

Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.

Zuker et al., Optimal computer folding of large RNA sequences using thermodynamics and auxiliary information. Nucleic Acids Res. Jan. 10, 1981;9(1):133-48. doi: 10.1093/nar/9.1.133.

Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.

Zuris et al., Cationic lipid-mediated delivery of proteins enables efficient protein-based genome editing in vitro and in vivo. Nat Biotechnol. 2015;33:73-80.

[No Author Listed] NCBI Reference Sequence: WP_032188360.1. Apr. 6, 2015. 1 page.

[No Author Listed], tRNA-specific adenosine deaminase [*Escherichia coli*]. GenBank Acc. No. CTS26096.1. Accessible at https://www.ncbi.nlm.nih.gov/protein/CTS26096.1. Aug. 22, 2015. 1 page.

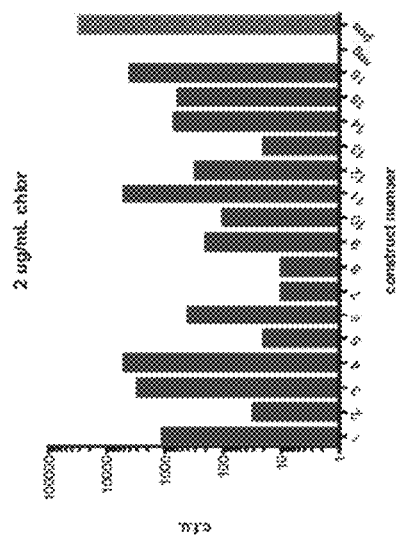
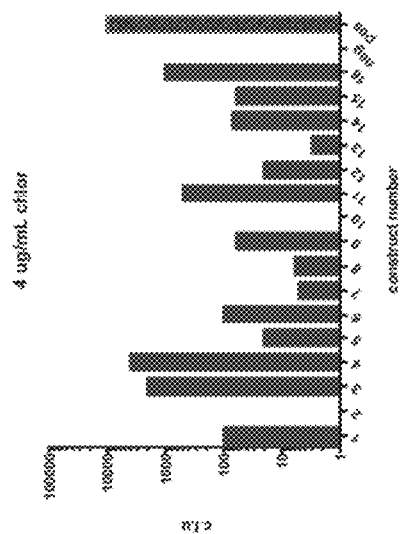
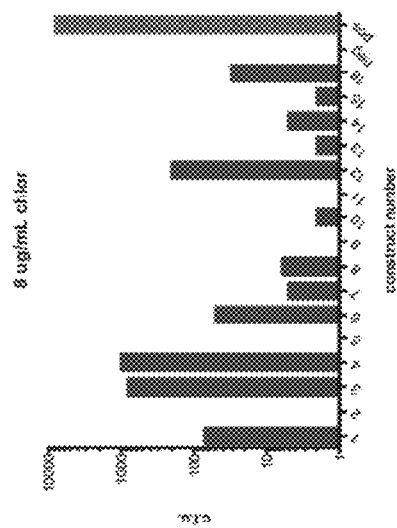
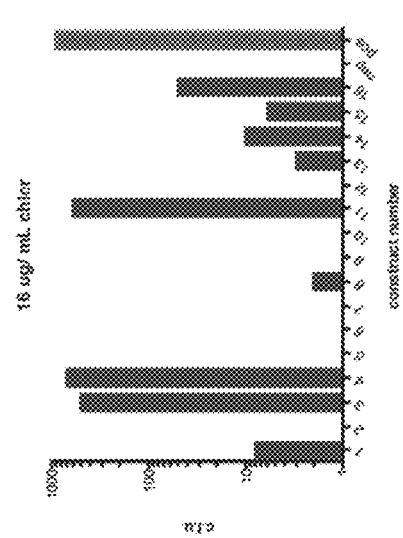
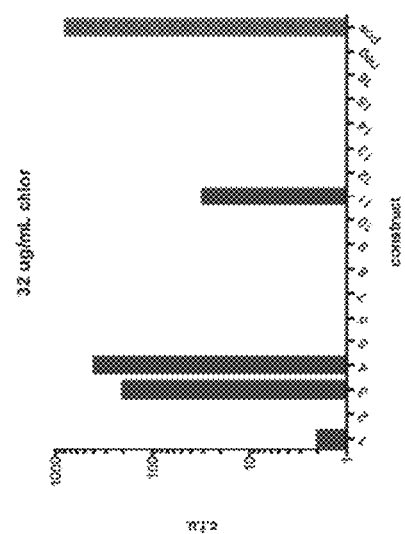
FIGURE 12

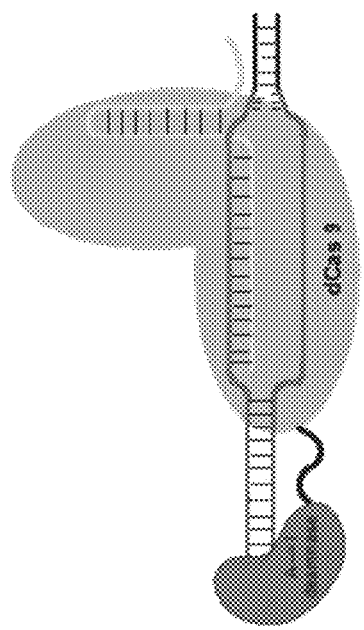
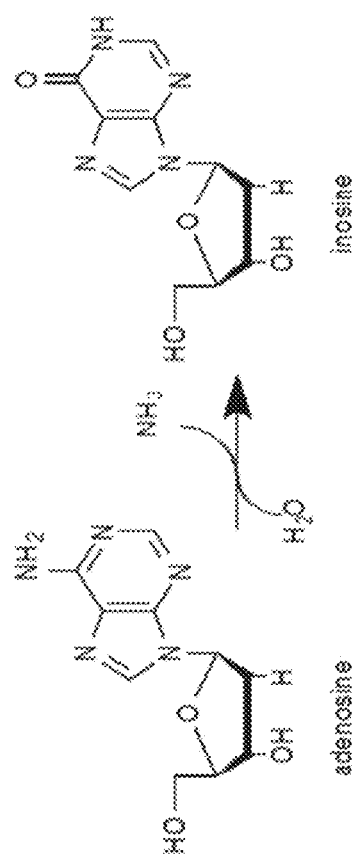
FIGURE 15

FIGURE 16

| position: | 6 | 26 | 61 | 68 | 70 | 106 | 107 | 108 | 109 | 127 | 147 | 152 | 154 | 155 | 161 | 163 | 166 |
|---|---|---|---|---|---|---|---|---|---|---|---|---|---|---|---|---|---|
| wt residue | His | Arg | Met | Leu | Met | Ala | Arg | Asn | Ala | Asn | Asn | Arg | Gln | Lys | Lys | Gln | Thr |
| 1pNMG-149 | Thr | | | | | | | Asn | | Ser | | | | | | | |
| 2pNMG-150 | Thr | | Ile | | Val | | | Asn | | Ser | Thr | Cys | His | Gly | | His | |
| 3nNMG-151 | Thr | | | | | | | Ser | | Ser | | | Arg | Val | | | Pro |
| 4pNMG-152 | Thr | Trp | | Gln | | Thr | | Asn | | Ser | | | | Asp | Gln | | |
| 5pNMG-153 | Thr | | | | | | | Asn | | Ser | Tyr | | | Val | | | |
| 6nNMG-154 | Thr | | | | | | | Asn | Thr | Ser | | | | Gly | | | |

FIGURE 46
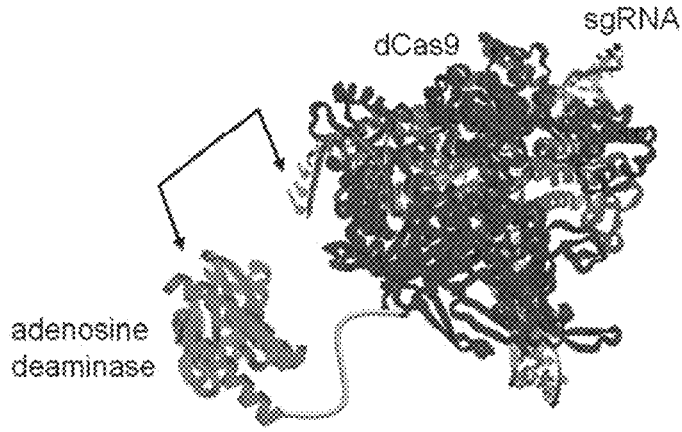
FIGURE 47
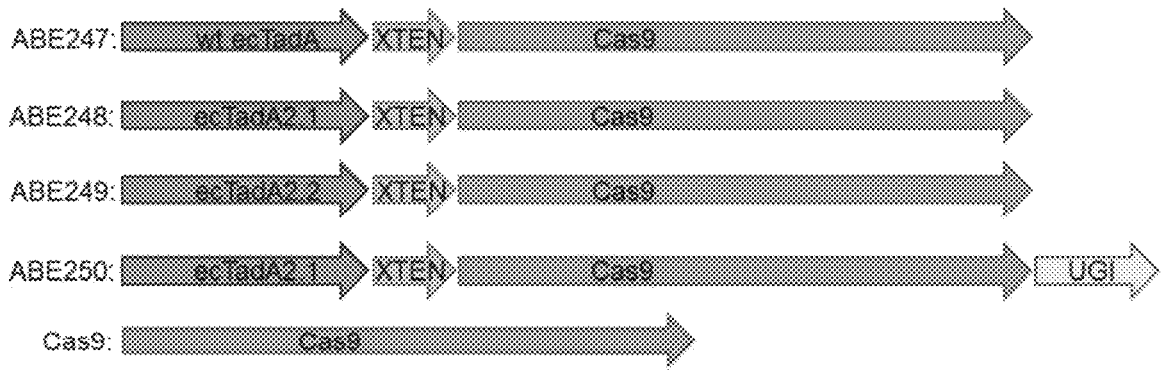
FIGURE 48
|  | EMX1 | FANCF | HEK2 | HEK3 | HEK4 | RNF2 |
|---|---|---|---|---|---|---|
| wtCas9 | 35.4% | 37.0% | 32.9% | 56.8% | 23.8% | 33.8% |
| ABE247 | 25.5% | 30.2% | 45.7% | 76.3% | 36.5% | 26.8% |
| ABE248 | 24.8% | 26.6% | 39.8% | 64.2% | 35.1% | 26.5% |
| ABE249 | 30.2% | 28.6% | 42.0% | 66.7% | 40.0% | 27.1% |
| ABE250 | 25.0% | 25.2% | 31.3% | 56.3% | 36.4% | 25.2% |
FIGURE 49
```
                protospacer              PAM
EMX1:         GA₅GTCCGA₈GCAGAAGAAGAAGGG
FANCF:        GGA₃A₄TCCCTTCTGCAGCACCTGG
HEK293 site 2: GA₂A₃CA₅CA₇A₈A₉GCATAGACTGCGGG
HEK293 site 3: GGCCCA₆GA₈CTGAGCACGTGATGG
HEK293 site 4: GGCA₄CTGCGGCTGGAGGTCCGGG
RNF2:         GTCA₄TCTTA₉GTCATTACCTGAGG
```

HEK293 site 2:   GA$_3$CA$_5$CA$_7$A$_8$A$_9$GCATAGACTGCGGG   (see high editing at A-5)

EMX1:   GA$_3$GTCCGA$_6$GCAGAAGAAGAAGGG   (see no editing)

HEK293 site 3:   GGCCCA$_6$GA$_6$CTGAGCACGTGATGG   (see low editing)

ABE142
ABE184
ABE177
ABE180

HEK293 site 2: GA$_4$A$_5$CA$_6$CA$_7$A$_8$A$_9$GCATAGACTGCGGG

RNF2 multi-A: A$_1$GA$_3$A$_4$A$_5$A$_6$A$_7$CA$_9$A$_{10}$TTTTAGTATTTGG

HEK3 multi-A: GCA$_3$GA$_5$A$_6$A$_7$TA$_9$GA$_{11}$CTAATTGCATGG

FIGURE 59

| HEK2 | | $A_2$ | $A_3$ | $A_5$ | $A_7$ | $A_8$ | $A_9$ |
|---|---|---|---|---|---|---|---|
| untreated | A | 100 | 100 | 100 | 100 | 100 | 100 |
| | C | 0 | 0 | 0 | 0 | 0 | 0 |
| | G | 0 | 0 | 0 | 0 | 0 | 0 |
| | T | 0 | 0 | 0 | 0 | 0 | 0 |
| XTEN | A | 100 | 99.8 | 90.6 | 100 | 100 | 100 |
| | C | 0 | 0 | 0 | 0 | 0 | 0 |
| | G | 0 | 0.2 | 9.4 | 0 | 0 | 0 |
| | T | 0 | 0 | 0 | 0 | 0 | 0 |
| GGS | A | 100 | 99.9 | 87.7 | 100 | 100 | 100 |
| | C | 0 | 0 | 0 | 0 | 0 | 0 |
| | G | 0 | 0.1 | 12.3 | 0 | 0 | 0 |
| | T | 0 | 0 | 0 | 0 | 0 | 0 |
| (GGS)$_2$XTEN(GGS)$_2$ | A | 100 | 99.9 | 77.6 | 100 | 100 | 100 |
| | C | 0 | 0 | 0 | 0 | 0 | 0 |
| | G | 0 | 0.1 | 22.4 | 0 | 0 | 0 |
| | T | 0 | 0 | 0 | 0 | 0 | 0 |

FIGURE 60

| | | EMX1 $A_2$ | $A_8$ | FANCF $A_3$ | $A_4$ | HEK3 $A_5$ | $A_8$ | HEK4 $A_4$ | RNF2 $A_4$ | $A_6$ |
|---|---|---|---|---|---|---|---|---|---|---|
| untreated | A | 100.0 | 100.0 | 100.0 | 100.0 | 100.0 | 100.0 | 100 | 100.0 | 100.0 |
| | C | 0.0 | 0.0 | 0.0 | 0.0 | 0.0 | 0.0 | 0 | 0.0 | 0.0 |
| | G | 0.0 | 0.0 | 0.0 | 0.0 | 0.0 | 0.0 | 0 | 0.0 | 0.0 |
| | T | 0.0 | 0.0 | 0.0 | 0.0 | 0.0 | 0.0 | 0 | 0.0 | 0.0 |
| XTEN (pNMG fwd: pCMV_secTadA_XTEN_Cas9n_GGS_NLS_D108G_D147Y_E155V) | A | 100.0 | 100.0 | 100.0 | 100.0 | 99.8 | 99.4 | 99.7 | 99.9 | 99.9 |
| | C | 0.0 | 0.0 | 0.0 | 0.0 | 0.0 | 0.0 | 0.0 | 0.0 | 0.0 |
| | G | 0.0 | 0.0 | 0.0 | 0.0 | 0.2 | 0.6 | 0.3 | 0.0 | 0.1 |
| | T | 0.0 | 0.0 | 0.0 | 0.0 | 0.0 | 0.0 | 0.0 | 0.0 | 0.0 |
| GGS (pNMG fwd: pCMV_secTadA_GGS_Cas9n_GGS_NLS_D108G_D147Y_E155V) | A | 100.0 | 100.0 | 100.0 | 99.8 | 99.7 | 99.8 | 99.5 | 99.9 | 100.0 |
| | C | 0.0 | 0.0 | 0.0 | 0.2 | 0.0 | 0.0 | 0.0 | 0.0 | 0.0 |
| | G | 0.0 | 0.0 | 0.0 | 0.2 | 0.2 | 0.2 | 0.4 | 0.0 | 0.0 |
| | T | 0.0 | 0.0 | 0.0 | 0.0 | 0.0 | 0.0 | 0.0 | 0.0 | 0.0 |
| (GGS)$_2$XTEN(GGS)$_2$ (pNMG fwd: pCMV_secTadA_(GGS)$_2$XTEN(GGS)$_2$_Cas9n_GGS_NLS_D108G_D147Y_E155V) | A | 100.0 | 99.8 | 100.0 | 99.9 | 99.8 | 99.0 | 99.4 | 99.9 | 99.9 |
| | C | 0.0 | 0.0 | 0.0 | 0.0 | 0.0 | 0.0 | 0.0 | 0.0 | 0.0 |
| | G | 0.0 | 0.2 | 0.0 | 0.1 | 0.2 | 1.0 | 0.6 | 0.1 | 0.1 |
| | T | 0.0 | 0.0 | 0.0 | 0.0 | 0.0 | 0.0 | 0.0 | 0.0 | 0.0 |

HEK293 site 2: GA$_1$A$_2$CA$_3$CA$_4$A$_5$GCATAGACTGCGGG
(showing as T to C)

FIGURE 72

Run # 1:

FANCF: GGA₃A₄TCCCTTCTGCAGCACCTGG

Run # 2:

FIGURE 75

| 142 (pCMV_ec TadA_XTE N_Cas9n_ GGS_NLS; wild-type) | parental | | | 142 (pCMV_ec TadA_XTE N_Cas9n_ GGS_NLS; wild-type) | out | | | 142 (pCMV_ec TadA_XTE N_Cas9n_ GGS_NLS; wild-type) | out | |
|---|---|---|---|---|---|---|---|---|---|---|
| | A₃ | A₄ | | | A₃ | A₄ | | | A₃ | A₄ |
| A | 100.0 | 100.0 | | A | 100.0 | 100.0 | | A | 100.0 | 100.0 |
| C | 0.0 | 0.0 | | C | 0.0 | 0.0 | | C | 0.0 | 0.0 |
| G | 0.0 | 0.0 | | G | 0.0 | 0.0 | | G | 0.0 | 0.0 |
| T | 0.0 | 0.0 | | T | 0.0 | 0.0 | | T | 0.0 | 0.0 |

| 177 (pCMV_ec TadA_XTE N_Cas9n_ GGS_NLS; A106V_D108N_D147Y_E155V) | | | | 177 (pCMV_ec TadA_XTE N_Cas9n_ GGS_NLS; A106V_D108N_D147Y_E155V) | | | | 177 (pCMV_ec TadA_XTE N_Cas9n_ GGS_NLS; A106V_D108N_D147Y_E155V) | | |
|---|---|---|---|---|---|---|---|---|---|---|
| A | 100.0 | 99.7 | | A | 100.0 | 99.8 | | A | 99.9 | 99.8 |
| C | 0.0 | 0.0 | | C | 0.0 | 0.0 | | C | 0.0 | 0.0 |
| G | 0.0 | 0.3 | | G | 0.0 | 0.2 | | G | 0.1 | 0.2 |
| T | 0.0 | 0.0 | | T | 0.0 | 0.0 | | T | 0.0 | 0.0 |

| 179 (pCMV_ec TadA_XTE N_Cas9n_ GGS_AAG* (E125Q)_GGS_NLS; A106V_D108N_D147Y_E155V) | | | | 179 (pCMV_ec TadA_XTE N_Cas9n_ GGS_AAG* (E125Q)_GGS_NLS; A106V_D108N_D147Y_E155V) | | | | 179 (pCMV_ec TadA_XTE N_Cas9n_ GGS_AAG* (E125Q)_GGS_NLS; A106V_D108N_D147Y_E155V) | | |
|---|---|---|---|---|---|---|---|---|---|---|
| A | 100.0 | 100.0 | | A | 100.0 | 99.9 | | A | 100.0 | 99.9 |
| C | 0.0 | 0.0 | | C | 0.0 | 0.0 | | C | 0.0 | 0.0 |
| G | 0.0 | 0.0 | | G | 0.0 | 0.1 | | G | 0.0 | 0.0 |
| T | 0.0 | 0.0 | | T | 0.0 | 0.0 | | T | 0.0 | 0.0 |

| 180 (pCMV_ec TadA_XTE N_Cas9n_ GGS_UGI_GGS_NLS; A106V_D108N_D147Y_E155V) | | | | 180 (pCMV_ec TadA_XTE N_Cas9n_ GGS_UGI_GGS_NLS; A106V_D108N_D147Y_E155V) | | | | 180 (pCMV_ec TadA_XTE N_Cas9n_ GGS_UGI_GGS_NLS; A106V_D108N_D147Y_E155V) | | |
|---|---|---|---|---|---|---|---|---|---|---|
| A | 100.0 | 99.8 | | A | 100.0 | 100.0 | | A | 100.0 | 99.9 |
| C | 0.0 | 0.0 | | C | 0.0 | 0.0 | | C | 0.0 | 0.0 |
| G | 0.0 | 0.2 | | G | 0.0 | 0.0 | | G | 0.0 | 0.1 |
| T | 0.0 | 0.0 | | T | 0.0 | 0.0 | | T | 0.0 | 0.0 |

| HEK2 | | A₂ | A₃ | A₅ | A₇ | A₈ | A₉ |
|---|---|---|---|---|---|---|---|
| 177 (pCMV_ecTadA_XTEN_Cas9n_GGS_NLS; A106V_D108N_D147Y_E155V) | A | 100.0 | 96.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 238 (pCMV_AAG*(E125A)_XTEN_ecTadA_XTEN_Cas9n_GGS_NLS; A106V_D108N_D147Y_E15 | A | 100.0 | 96.9 | 74.8 | 99.9 | 100.0 | 100.0 |
| | C | 0.0 | 0.0 | 0.0 | 0.0 | 0.0 | 0.0 |
| | G | 0.0 | 0.1 | 25.2 | 0.1 | 0.0 | 0.0 |
| | T | 0.0 | 0.0 | 0.0 | 0.0 | 0.0 | 0.0 |
| 239 (pCMV_AAG*(wt)_XTEN_ecTadA_XTEN_Cas9n_GGS_NLS; A106V_D108N_D147Y_E15 | A | 100.0 | 96.8 | 69.0 | 99.9 | 99.9 | 100.0 |
| | C | 0.0 | 0.0 | 0.1 | 0.0 | 0.0 | 0.0 |
| | G | 0.0 | 0.2 | 30.9 | 0.1 | 0.1 | 0.0 |
| | T | 0.0 | 0.0 | 0.0 | 0.0 | 0.0 | 0.0 |

FIGURE 86
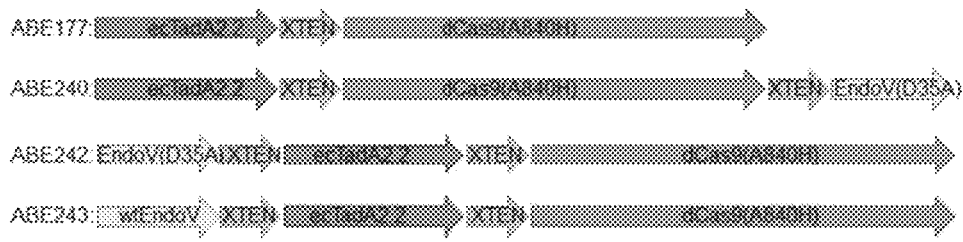
FIGURE 87
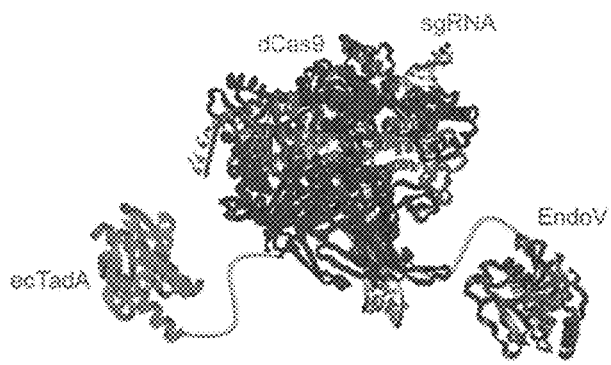
FIGURE 88
| HEK2 | | $A_4$ | $A_5$ | $A_6$ | $A_7$ | $A_8$ | $A_9$ |
|---|---|---|---|---|---|---|---|
| 177 (pCMV_ecTadA_ XTEN_Cas9n_G GS_NLS; A106V_D108N_ D147Y_E155V) | A | 100.0 | 99.7 | 74.1 | 100.0 | 99.9 | 100.0 |
| | C | 0.0 | 0.0 | 0.0 | 0.0 | 0.0 | 0.0 |
| | G | 0.0 | 0.3 | 25.9 | 0.0 | 0.1 | 0.0 |
| | T | 0.0 | 0.0 | 0.0 | 0.0 | 0.0 | 0.0 |
| 240 (pCMV_ecTadA_ XTEN_Cas9n_XT EN_EndoV*(D35 A)_GGS_NLS; A106V_D108N_ D147Y_E155V) | A | 100.0 | 99.7 | 64.8 | 99.9 | 99.9 | 99.9 |
| | C | 0.0 | 0.0 | 0.0 | 0.0 | 0.0 | 0.0 |
| | G | 0.0 | 0.3 | 35.2 | 0.1 | 0.1 | 0.1 |
| | T | 0.0 | 0.0 | 0.0 | 0.0 | 0.0 | 0.0 |
| 242 (pCMV_EndoV*( D35A)_XTEN_ec TadA_XTEN_Cas 9n_GGS_NLS; A106V_D108N_ D147Y_E155V) | A | 100.0 | 99.8 | 53.8 | 100.0 | 99.9 | 100.0 |
| | C | 0.0 | 0.0 | 0.0 | 0.0 | 0.0 | 0.0 |
| | G | 0.0 | 0.1 | 46.2 | 0.0 | 0.1 | 0.0 |
| | T | 0.0 | 0.0 | 0.0 | 0.0 | 0.0 | 0.0 |
| 243 (pCMV_EndoV*( wt)_XTEN_ecTad A_XTEN_Cas9n_ GGS_NLS; A106V_D108N_ D147Y_E155V) | A | 100.0 | 99.9 | 67.9 | 99.9 | 99.9 | 100.0 |
| | C | 0.0 | 0.0 | 0.0 | 0.0 | 0.1 | 0.0 |
| | G | 0.0 | 0.1 | 32.0 | 0.0 | 0.0 | 0.0 |
| | T | 0.0 | 0.0 | 0.0 | 0.0 | 0.0 | 0.0 |

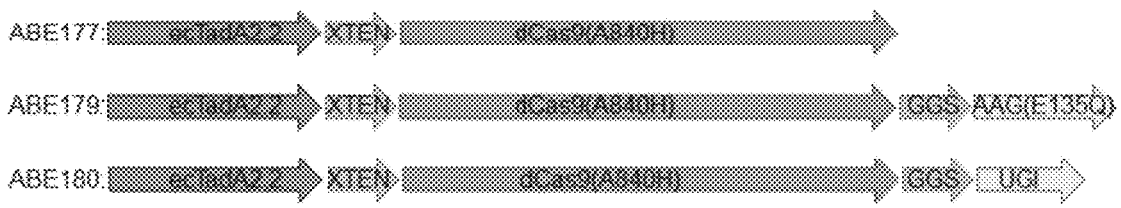

| wt res | S2 | H8 | I49 | L84 | A106 | D108 | H123 | N127 | D147 | E155 | I156 | K160 |
|---|---|---|---|---|---|---|---|---|---|---|---|---|
| clone 1 |  |  |  | Phe | Val | Arg | Tyr |  | Tyr | Val | Phe |  |
| clone 2 | Ala | Phe |  | Val | Arg |  |  |  | Tyr | Val |  |  |
| clone 3 |  |  | Tyr | Thr | Arg |  |  | Ser | Asp | Glu |  | Ser |

| HEK2 | G | A | A | C | A | C | A | A | A | G |
|---|---|---|---|---|---|---|---|---|---|---|
| 339 | | 0.1% | 5.0% | | | | 1.6% | 1.9% | 0.9% | |
| 340 | | 0.1% | 2.6% | | | | 0.5% | 1.1% | 0.6% | |
| 341 | | 0.1% | 6.0% | | | | 1.7% | 1.6% | 1.1% | |

| HEK2 | G | G | A | A | C | A | C | A | A | A |
|---|---|---|---|---|---|---|---|---|---|---|
| 339 | | 2.2% | | | | | | 6.6% | 23.3% | 2.1% |
| 340 | | 1.4% | 31.0% | | | 36.0% | | 2.6% | 19.6% | 1.5% |
| 341 | | 1.9% | 57.1% | | | | | 5.7% | 18.1% | 2.0% |

| HEK2-3 | G | T | A | A | A | C | A | A | A | G |
|---|---|---|---|---|---|---|---|---|---|---|
| 339 | | | 0.5% | 1.0% | 19.3% | | 0.6% | 1.5% | 0.7% | |
| 340 | | | 0.2% | 0.4% | 17.2% | | 0.2% | 0.7% | 0.3% | |
| 341 | | | 0.5% | 1.0% | 19.5% | | 0.6% | 1.3% | 0.5% | |

| HEK2-6 | G | A | A | G | A | C | C | A | A | G |
|---|---|---|---|---|---|---|---|---|---|---|
| 339 | | 0.0% | 0.1% | | 7.2% | | | 0.4% | 0.3% | |
| 340 | | 0.0% | 0.0% | | 6.1% | | | 0.2% | 0.1% | |
| 341 | | 0.0% | 0.0% | | 6.6% | | | 0.4% | 0.3% | |

| HEK2-7 | G | A | A | A | A | C | A | A | A | T |
|---|---|---|---|---|---|---|---|---|---|---|
| 339 | | 0.0% | 0.0% | 0.0% | 0.6% | | 0.0% | 0.0% | 0.0% | |
| 340 | | 0.0% | 0.0% | 0.0% | 0.3% | | 0.0% | 0.0% | 0.0% | |
| 341 | | 0.0% | 0.0% | 0.0% | 0.4% | | 0.1% | 0.0% | 0.0% | |

| HEK2-8 | G | A | T | C | A | C | A | A | A | G |
|---|---|---|---|---|---|---|---|---|---|---|
| 339 | | 0.2% | | | 23.9% | | 0.5% | 0.5% | 0.3% | |
| 340 | | 0.1% | | | 26.0% | | 0.2% | 0.2% | 0.1% | |
| 341 | | 0.2% | | | 27.5% | | 0.5% | 0.4% | 0.3% | |

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-369 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #3 | A | 99.93% | 97.44% | | 99.03% | 99.17% | 99.59% | 99.96% | 99.97% | 100.0% |
| | C | 0.00% | 0.00% | 0.01% | 0.00% | 0.00% | 0.00% | 0.00% | 0.00% | 0.0% |
| | G | 0.07% | 2.56% | | 0.96% | 0.83% | 0.41% | 0.03% | 0.02% | 0.0% |
| | T | 0.00% | 0.01% | 0.02% | 0.01% | 0.00% | 0.00% | 0.01% | 0.00% | 0.0% |

| HEK2 pNMG-370 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #2 | A | 99.94% | 98.55% | | 99.71% | 99.40% | 99.80% | 99.96% | 99.97% | 100.0% |
| | C | 0.00% | 0.00% | 0.00% | 0.00% | 0.00% | 0.00% | 0.00% | 0.00% | 0.0% |
| | G | 0.05% | 1.44% | | 0.29% | 0.59% | 0.20% | 0.03% | 0.02% | 0.0% |
| | T | 0.01% | 0.01% | 0.02% | 0.00% | 0.00% | 0.00% | 0.01% | 0.00% | 0.0% |

| HEK2 pNMG-371 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #3 | A | 99.91% | 96.97% | | 99.11% | 99.06% | 99.41% | 99.96% | 99.98% | 100.0% |
| | C | 0.00% | 0.00% | 0.00% | 0.00% | 0.00% | 0.00% | 0.00% | 0.00% | 0.0% |
| | G | 0.09% | 3.02% | | 0.89% | 0.93% | 0.59% | 0.03% | 0.01% | 0.0% |
| | T | 0.00% | 0.00% | 0.01% | 0.00% | 0.00% | 0.00% | 0.01% | 0.00% | 0.0% |

| HEK2 pNMG-360 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.92% | 98.69% | | 99.68% | 99.71% | 99.92% | 99.95% | 99.97% | 100.0% |
| | C | 0.00% | 0.00% | 0.01% | 0.00% | 0.00% | 0.00% | 0.00% | 0.00% | 0.0% |
| | G | 0.07% | 1.30% | | 0.32% | 0.28% | 0.07% | 0.04% | 0.02% | 0.0% |
| | T | 0.01% | 0.00% | 0.01% | 0.00% | 0.01% | 0.00% | 0.00% | 0.00% | 0.0% |

| HEK2 pNMG-361 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.94% | 98.96% | | 99.81% | 99.68% | 99.92% | 99.98% | 99.97% | 100.0% |
| | C | 0.00% | 0.00% | 0.01% | 0.00% | 0.00% | 0.00% | 0.00% | 0.00% | 0.0% |
| | G | 0.05% | 1.04% | | 0.18% | 0.31% | 0.08% | 0.01% | 0.02% | 0.0% |
| | T | 0.00% | 0.00% | 0.00% | 0.00% | 0.00% | 0.00% | 0.00% | 0.00% | 0.0% |

| HEK2 pNMG-362 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.96% | 99.14% | | 99.78% | 99.79% | 99.86% | 99.91% | 99.98% | 100.0% |
| | C | 0.00% | 0.00% | 0.00% | 0.00% | 0.00% | 0.00% | 0.00% | 0.00% | 0.0% |
| | G | 0.04% | 0.86% | | 0.21% | 0.20% | 0.14% | 0.08% | 0.01% | 0.0% |
| | T | 0.00% | 0.01% | 0.01% | 0.00% | 0.00% | 0.00% | 0.01% | 0.00% | 0.0% |

FIGURE 108 (Continued)

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-363 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.92% | 98.69% | | 99.66% | 99.71% | 99.92% | 99.95% | 99.97% | 100.0% |
| | C | 0.00% | 0.00% | 0.01% | 0.00% | 0.00% | 0.00% | 0.00% | 0.00% | 0.0% |
| | G | 0.07% | 1.30% | | 0.32% | 0.28% | 0.07% | 0.04% | 0.02% | 0.0% |
| | T | 0.01% | 0.00% | 0.01% | 0.01% | 0.01% | 0.00% | 0.00% | 0.00% | 0.0% |

| HEK2 pNMG-364 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.97% | 99.01% | | 99.68% | 99.78% | 99.90% | 99.95% | 99.97% | 100.0% |
| | C | 0.00% | 0.00% | 0.00% | 0.00% | 0.00% | 0.00% | 0.00% | 0.00% | 0.0% |
| | G | 0.03% | 0.98% | | 0.32% | 0.21% | 0.10% | 0.04% | 0.02% | 0.0% |
| | T | 0.00% | 0.00% | 0.02% | 0.00% | 0.01% | 0.01% | 0.01% | 0.00% | 0.0% |

| HEK2 pNMG-365 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.97% | 99.08% | | 99.81% | 99.78% | 99.90% | 99.95% | 99.98% | 100.0% |
| | C | 0.00% | 0.00% | 0.00% | 0.00% | 0.00% | 0.00% | 0.00% | 0.00% | 0.0% |
| | G | 0.03% | 0.91% | | 0.18% | 0.21% | 0.10% | 0.04% | 0.01% | 0.0% |
| | T | 0.00% | 0.00% | 0.01% | 0.00% | 0.01% | 0.01% | 0.01% | 0.00% | 0.0% |

| HEK2 pNMG-366 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.90% | 98.23% | | 99.59% | 99.73% | 99.85% | 99.93% | 99.97% | 100.0% |
| | C | 0.00% | 0.00% | 0.00% | 0.00% | 0.00% | 0.00% | 0.00% | 0.00% | 0.0% |
| | G | 0.10% | 1.76% | | 0.41% | 0.26% | 0.15% | 0.06% | 0.02% | 0.0% |
| | T | 0.00% | 0.00% | 0.01% | 0.00% | 0.00% | 0.00% | 0.01% | 0.00% | 0.0% |

| HEK2 pNMG-367 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.92% | 98.73% | | 99.66% | 99.78% | 99.90% | 99.95% | 99.97% | 100.0% |
| | C | 0.00% | 0.00% | 0.01% | 0.00% | 0.00% | 0.00% | 0.00% | 0.00% | 0.0% |
| | G | 0.08% | 1.26% | | 0.32% | 0.21% | 0.10% | 0.04% | 0.02% | 0.0% |
| | T | 0.00% | 0.01% | 0.01% | 0.00% | 0.01% | 0.01% | 0.01% | 0.00% | 0.0% |

| HEK2 pNMG-368 | | 2 | 3 | 5 | 7 | 8 | 9 | 12 | 14 | 16 |
|---|---|---|---|---|---|---|---|---|---|---|
| | | A | A | A | A | A | A | A | A | A |
| Evo #4 | A | 99.97% | 99.72% | 99.32% | 99.95% | 99.92% | 99.96% | 99.97% | 99.98% | 100.0% |
| | C | 0.00% | 0.00% | 0.00% | 0.00% | 0.00% | 0.00% | 0.00% | 0.00% | 0.0% |
| | G | 0.02% | 0.27% | 0.67% | 0.05% | 0.08% | 0.03% | 0.02% | 0.01% | 0.0% |
| | T | 0.00% | 0.00% | 0.01% | 0.00% | 0.00% | 0.00% | 0.01% | 0.00% | 0.0% |

FIGURE 109

HEK2-3 site: 5'-GTA$_3$A$_4$A$_5$CA$_7$A$_8$A$_9$GCA$_{12}$TA$_{14}$GA$_{16}$CTGAGGG-3'

| HEK2-3 pNMG-369 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.73% | 99.58% | 93.69% | 99.55% | 99.15% | 99.93% | 99.96% | 99.98% | 100.00% |
| | C | 0.01% | 0.00% | 0.01% | 0.01% | 0.00% | 0.00% | 0.01% | 0.00% | 0.00% |
| | G | 0.25% | 0.41% | 6.30% | 0.44% | 0.85% | 0.07% | 0.02% | 0.01% | 0.00% |
| | T | 0.01% | 0.01% | 0.00% | 0.00% | 0.00% | 0.00% | 0.01% | 0.00% | 0.00% |

| HEK2-3 pNMG-370 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.93% | 99.89% | 94.96% | 99.92% | 99.74% | 99.98% | 99.99% | 99.98% | 99.99% |
| | C | 0.01% | 0.00% | 0.01% | 0.01% | 0.00% | 0.00% | 0.00% | 0.00% | 0.00% |
| | G | 0.06% | 0.11% | 5.03% | 0.07% | 0.25% | 0.02% | 0.00% | 0.01% | 0.00% |
| | T | 0.01% | 0.00% | 0.00% | 0.00% | 0.01% | 0.00% | 0.00% | 0.00% | 0.01% |

| HEK2-3 pNMG-371 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.69% | 99.59% | 93.53% | 99.75% | 99.46% | 99.94% | 99.96% | 99.98% | 99.99% |
| | C | 0.01% | 0.01% | 0.01% | 0.02% | 0.02% | 0.01% | 0.02% | 0.01% | 0.01% |
| | G | 0.30% | 0.40% | 6.45% | 0.23% | 0.52% | 0.05% | 0.01% | 0.01% | 0.01% |
| | T | 0.00% | 0.00% | 0.00% | 0.00% | 0.00% | 0.00% | 0.01% | 0.00% | 0.00% |

| HEK2-3 pNMG-360 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.82% | 99.89% | 98.74% | 99.90% | 99.92% | 99.98% | 99.98% | 99.98% | 99.99% |
| | C | 0.00% | 0.00% | 0.01% | 0.02% | 0.02% | 0.01% | 0.00% | 0.00% | 0.00% |
| | G | 0.18% | 0.10% | 1.25% | 0.08% | 0.06% | 0.01% | 0.01% | 0.01% | 0.01% |
| | T | 0.00% | 0.00% | 0.00% | 0.00% | 0.00% | 0.00% | 0.01% | 0.00% | 0.00% |

| HEK2-3 pNMG-361 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.98% | 99.54% | 99.97% | 99.98% | 99.99% | 99.98% | 99.99% | 99.98% |
| | C | 0.00% | 0.00% | 0.01% | 0.01% | 0.00% | 0.00% | 0.00% | 0.00% | 0.00% |
| | G | 0.03% | 0.02% | 0.44% | 0.02% | 0.01% | 0.00% | 0.01% | 0.00% | 0.01% |
| | T | 0.00% | 0.00% | 0.00% | 0.00% | 0.00% | 0.00% | 0.01% | 0.01% | 0.00% |

| HEK2-3 pNMG-362 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.91% | 99.94% | 98.06% | 99.93% | 99.85% | 99.96% | 99.98% | 99.98% | 99.99% |
| | C | 0.01% | 0.00% | 0.00% | 0.01% | 0.00% | 0.00% | 0.00% | 0.00% | 0.00% |
| | G | 0.09% | 0.06% | 1.93% | 0.06% | 0.15% | 0.04% | 0.02% | 0.02% | 0.00% |
| | T | 0.00% | 0.00% | 0.00% | 0.00% | 0.00% | 0.00% | 0.00% | 0.00% | 0.01% |

FIGURE 109 (Continued)

HEK2-3 site: 5'-GTA$_3$A$_4$A$_5$CA$_7$A$_8$A$_9$GCA$_{12}$TA$_{14}$GA$_{16}$CTGAGGG-3'

| HEK2-3 pNMG-363 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.80% | 99.91% | 97.59% | 99.90% | 99.89% | 99.97% | 99.96% | 99.99% | 99.99% |
| | C | 0.00% | 0.00% | 0.01% | 0.00% | 0.01% | 0.00% | 0.01% | 0.00% | 0.00% |
| | G | 0.19% | 0.09% | 2.40% | 0.09% | 0.10% | 0.03% | 0.02% | 0.01% | 0.00% |
| | T | 0.00% | 0.00% | 0.00% | 0.00% | 0.01% | 0.00% | 0.02% | 0.00% | 0.00% |

| HEK2-3 pNMG-364 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.96% | 99.97% | 99.47% | 99.96% | 99.98% | 100.00% | 99.99% | 99.98% | 100.00% |
| | C | 0.01% | 0.00% | 0.01% | 0.01% | 0.00% | 0.00% | 0.00% | 0.00% | 0.00% |
| | G | 0.03% | 0.02% | 0.51% | 0.04% | 0.01% | 0.00% | 0.00% | 0.01% | 0.00% |
| | T | 0.01% | 0.00% | 0.01% | 0.00% | 0.00% | 0.00% | 0.00% | 0.01% | 0.00% |

| HEK2-3 pNMG-365 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.91% | 99.97% | 98.49% | 99.95% | 99.92% | 99.97% | 99.92% | 99.98% | 100.00% |
| | C | 0.00% | 0.00% | 0.00% | 0.01% | 0.01% | 0.00% | 0.00% | 0.00% | 0.00% |
| | G | 0.09% | 0.02% | 1.51% | 0.04% | 0.07% | 0.02% | 0.07% | 0.01% | 0.00% |
| | T | 0.00% | 0.00% | 0.00% | 0.00% | 0.00% | 0.00% | 0.01% | 0.00% | 0.00% |

| HEK2-3 pNMG-366 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.70% | 99.86% | 97.73% | 99.68% | 99.77% | 99.97% | 99.98% | 99.99% | 99.99% |
| | C | 0.00% | 0.00% | 0.00% | 0.01% | 0.01% | 0.01% | 0.00% | 0.00% | 0.00% |
| | G | 0.29% | 0.14% | 2.27% | 0.30% | 0.22% | 0.02% | 0.02% | 0.00% | 0.00% |
| | T | 0.00% | 0.00% | 0.00% | 0.00% | 0.00% | 0.00% | 0.00% | 0.00% | 0.01% |

| HEK2-3 pNMG-367 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.87% | 99.89% | 97.80% | 99.87% | 99.91% | 99.97% | 99.92% | 99.96% | 99.99% |
| | C | 0.00% | 0.00% | 0.00% | 0.01% | 0.01% | 0.00% | 0.01% | 0.00% | 0.00% |
| | G | 0.12% | 0.10% | 2.19% | 0.11% | 0.08% | 0.02% | 0.05% | 0.02% | 0.01% |
| | T | 0.01% | 0.00% | 0.00% | 0.00% | 0.00% | 0.00% | 0.01% | 0.01% | 0.00% |

| HEK2-3 pNMG-368 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.97% | 100.00% | 100.00% | 99.99% | 99.98% | 100.00% | 99.98% | 99.98% | 100.00% |
| | C | 0.00% | 0.00% | 0.00% | 0.01% | 0.01% | 0.00% | 0.00% | 0.01% | 0.00% |
| | G | 0.02% | 0.00% | 0.00% | 0.00% | 0.00% | 0.00% | 0.01% | 0.01% | 0.00% |
| | T | 0.00% | 0.00% | 0.00% | 0.01% | 0.01% | 0.00% | 0.01% | 0.00% | 0.00% |

FIGURE 110

HEK2-6: 5'-GA$_2$A$_3$GA$_5$CCA$_8$A$_9$GGA$_{12}$TA$_{14}$GACTGCTGG-3'

| HEK2-6 pNMG-369 | | 2 | 3 | 5 | 8 | 9 | 12 | 14 |
|---|---|---|---|---|---|---|---|---|
| | | A | A | A | A | A | A | A |
| | A | 99.80% | 99.94% | 95.27% | 99.70% | 99.74% | 99.94% | 99.94% |
| | C | 0.07% | 0.06% | 0.00% | 0.00% | 0.00% | 0.00% | 0.00% |
| | G | 0.13% | 0.00% | 4.67% | 0.30% | 0.26% | 0.06% | 0.06% |
| | T | 0.00% | 0.00% | 0.06% | 0.00% | 0.00% | 0.00% | 0.00% |

| HEK2-6 pNMG-370 | | 2 | 3 | 5 | 8 | 9 | 12 | 14 |
|---|---|---|---|---|---|---|---|---|
| | | A | A | A | A | A | A | A |
| | A | 99.97% | 99.98% | 96.45% | 99.77% | 99.92% | 99.98% | 99.98% |
| | C | 0.03% | 0.02% | 0.00% | 0.00% | 0.03% | 0.00% | 0.00% |
| | G | 0.00% | 0.00% | 3.50% | 0.23% | 0.03% | 0.02% | 0.02% |
| | T | 0.00% | 0.00% | 0.05% | 0.00% | 0.03% | 0.00% | 0.00% |

| HEK2-6 pNMG-371 | | 2 | 3 | 5 | 8 | 9 | 12 | 14 |
|---|---|---|---|---|---|---|---|---|
| | | A | A | A | A | A | A | A |
| | A | 99.97% | 99.94% | 96.33% | 99.80% | 99.78% | 100.00% | 100.00% |
| | C | 0.00% | 0.03% | 0.00% | 0.00% | 0.00% | 0.00% | 0.00% |
| | G | 0.03% | 0.00% | 3.67% | 0.20% | 0.19% | 0.00% | 0.00% |
| | T | 0.00% | 0.03% | 0.00% | 0.00% | 0.03% | 0.00% | 0.00% |

| HEK2-6 pNMG-360 | | 2 | 3 | 5 | 8 | 9 | 12 | 14 |
|---|---|---|---|---|---|---|---|---|
| | | A | A | A | A | A | A | A |
| | A | 100.00% | 99.96% | 99.03% | 99.96% | 99.91% | 99.96% | 100.00% |
| | C | 0.00% | 0.04% | 0.00% | 0.00% | 0.09% | 0.00% | 0.00% |
| | G | 0.00% | 0.00% | 0.97% | 0.04% | 0.00% | 0.04% | 0.00% |
| | T | 0.00% | 0.00% | 0.00% | 0.00% | 0.00% | 0.00% | 0.00% |

| HEK2-6 361 | | 2 | 3 | 5 | 8 | 9 | 12 | 14 |
|---|---|---|---|---|---|---|---|---|
| | | A | A | A | A | A | A | A |
| | A | 99.97% | 99.97% | 99.67% | 100.00% | 99.97% | 99.97% | 100.00% |
| | C | 0.00% | 0.00% | 0.00% | 0.00% | 0.00% | 0.00% | 0.00% |
| | G | 0.03% | 0.03% | 0.30% | 0.00% | 0.00% | 0.03% | 0.00% |
| | T | 0.00% | 0.00% | 0.03% | 0.00% | 0.03% | 0.00% | 0.00% |

| HEK2-6 362 | | 2 | 3 | 5 | 8 | 9 | 12 | 14 |
|---|---|---|---|---|---|---|---|---|
| | | A | A | A | A | A | A | A |
| | A | 99.96% | 99.92% | 98.65% | 99.94% | 99.98% | 99.94% | 99.98% |
| | C | 0.02% | 0.08% | 0.00% | 0.00% | 0.00% | 0.00% | 0.00% |
| | G | 0.02% | 0.00% | 1.35% | 0.04% | 0.02% | 0.04% | 0.02% |
| | T | 0.00% | 0.00% | 0.00% | 0.02% | 0.00% | 0.02% | 0.00% |

FIGURE 110 (Continued)

HEK2-6: 5'-GA$_2$A$_3$GA$_5$CCA$_8$A$_9$GGA$_{12}$TA$_{14}$GACTGCTGG-3'

| HEK2-6 363 | | 2 | 3 | 5 | 8 | 9 | 12 | 14 |
|---|---|---|---|---|---|---|---|---|
| | | A | A | A | A | A | A | A |
| | A | 99.97% | 99.97% | 95.64% | 99.93% | 99.99% | 99.99% | 99.99% |
| | C | 0.00% | 0.00% | 0.00% | 0.00% | 0.00% | 0.00% | 0.00% |
| | G | 0.03% | 0.03% | 4.36% | 0.05% | 0.01% | 0.00% | 0.00% |
| | T | 0.00% | 0.00% | 0.00% | 0.01% | 0.00% | 0.01% | 0.01% |

| HEK2-6 364 | | 2 | 3 | 5 | 8 | 9 | 12 | 14 |
|---|---|---|---|---|---|---|---|---|
| | | A | A | A | A | A | A | A |
| | A | 99.98% | 99.98% | 99.59% | 99.98% | 99.90% | 99.98% | 100.00% |
| | C | 0.00% | 0.00% | 0.00% | 0.00% | 0.02% | 0.00% | 0.00% |
| | G | 0.00% | 0.02% | 0.39% | 0.02% | 0.06% | 0.02% | 0.00% |
| | T | 0.02% | 0.00% | 0.02% | 0.00% | 0.02% | 0.00% | 0.00% |

| HEK2-6 365 | | 2 | 3 | 5 | 8 | 9 | 12 | 14 |
|---|---|---|---|---|---|---|---|---|
| | | A | A | A | A | A | A | A |
| | A | 99.95% | 100.00% | 97.12% | 99.95% | 99.82% | 99.85% | 100.00% |
| | C | 0.00% | 0.00% | 0.00% | 0.00% | 0.00% | 0.03% | 0.00% |
| | G | 0.03% | 0.00% | 2.86% | 0.02% | 0.18% | 0.10% | 0.00% |
| | T | 0.03% | 0.00% | 0.02% | 0.02% | 0.00% | 0.03% | 0.00% |

| HEK2-6 366 | | 2 | 3 | 5 | 8 | 9 | 12 | 14 |
|---|---|---|---|---|---|---|---|---|
| | | A | A | A | A | A | A | A |
| | A | 99.90% | 99.96% | 97.54% | 99.82% | 99.98% | 99.88% | 99.98% |
| | C | 0.04% | 0.00% | 0.00% | 0.00% | 0.02% | 0.00% | 0.00% |
| | G | 0.02% | 0.04% | 2.46% | 0.15% | 0.00% | 0.08% | 0.02% |
| | T | 0.04% | 0.00% | 0.00% | 0.04% | 0.00% | 0.04% | 0.00% |

| HEK2-6 367 | | 2 | 3 | 5 | 8 | 9 | 12 | 14 |
|---|---|---|---|---|---|---|---|---|
| | | A | A | A | A | A | A | A |
| | A | 99.89% | 99.99% | 97.00% | 99.93% | 99.94% | 99.96% | 99.99% |
| | C | 0.03% | 0.00% | 0.01% | 0.01% | 0.01% | 0.01% | 0.00% |
| | G | 0.06% | 0.01% | 2.97% | 0.04% | 0.03% | 0.00% | 0.00% |
| | T | 0.02% | 0.00% | 0.01% | 0.01% | 0.01% | 0.03% | 0.01% |

| HEK2-6 368 | | 2 | 3 | 5 | 8 | 9 | 12 | 14 |
|---|---|---|---|---|---|---|---|---|
| | | A | A | A | A | A | A | A |
| | A | 99.92% | 99.96% | 99.96% | 99.99% | 99.99% | 99.98% | 100.00% |
| | C | 0.02% | 0.02% | 0.00% | 0.00% | 0.01% | 0.00% | 0.00% |
| | G | 0.04% | 0.02% | 0.01% | 0.01% | 0.00% | 0.01% | 0.00% |
| | T | 0.02% | 0.00% | 0.03% | 0.00% | 0.00% | 0.01% | 0.00% |

FIGURE 111

HEK2-7: 3'-CCTGCAGT CAAT GAT T T GT T T T G-5'

| HEK2-7 pNMG-369 | | 16 T | 12 T | 9 T | 8 T | 7 T | 5 T | 4 T | 3 T | 2 T |
|---|---|---|---|---|---|---|---|---|---|---|
| | A | 0.00% | 0.01% | 0.00% | 0.01% | 0.00% | 0.00% | 0.00% | 0.00% | 0.00% |
| | C | 0.01% | 0.01% | 0.08% | 0.09% | 0.05% | 0.83% | 0.06% | 0.03% | 0.02% |
| | G | 0.00% | 0.00% | 0.00% | 0.00% | 0.00% | 0.00% | 0.00% | 0.00% | 0.00% |
| | T | 99.98% | 99.98% | 99.91% | 99.91% | 99.95% | 99.16% | 99.93% | 99.96% | 99.98% |

| HEK2-7 pNMG-370 | | 16 T | 12 T | 9 T | 8 T | 7 T | 5 T | 4 T | 3 T | 2 T |
|---|---|---|---|---|---|---|---|---|---|---|
| | A | 0.01% | 0.01% | 0.00% | 0.01% | 0.00% | 0.00% | 0.01% | 0.01% | 0.01% |
| | C | 0.00% | 0.00% | 0.01% | 0.00% | 0.01% | 0.24% | 0.01% | 0.01% | 0.01% |
| | G | 0.01% | 0.00% | 0.00% | 0.00% | 0.01% | 0.01% | 0.01% | 0.00% | 0.00% |
| | T | 99.99% | 99.99% | 99.99% | 99.99% | 99.98% | 99.75% | 99.98% | 99.98% | 99.98% |

| HEK2-7 pNMG-371 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.01% | 0.00% | 0.00% | 0.00% |
| | C | 0.00% | 0.01% | 0.06% | 0.04% | 0.10% | 0.35% | 0.02% | 0.01% | 0.00% |
| | G | 0.00% | 0.00% | 0.00% | 0.00% | 0.00% | 0.00% | 0.00% | 0.00% | 0.03% |
| | T | 100.00% | 99.99% | 99.98% | 99.96% | 99.90% | 99.63% | 99.98% | 99.99% | 99.97% |

| HEK2-7 pNMG-360 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.01% | 0.01% | 0.01% | 0.00% | 0.00% | 0.01% |
| | C | 0.01% | 0.00% | 0.01% | 0.03% | 0.00% | 0.09% | 0.03% | 0.02% | 0.02% |
| | G | 0.00% | 0.00% | 0.01% | 0.00% | 0.00% | 0.00% | 0.00% | 0.00% | 0.01% |
| | T | 99.99% | 100.00% | 99.98% | 99.95% | 99.99% | 99.89% | 99.97% | 99.98% | 99.95% |

| HEK2-7 pNMG-361 | | 16 T | 12 T | 9 T | 8 T | 7 T | 5 T | 4 T | 3 T | 2 T |
|---|---|---|---|---|---|---|---|---|---|---|
| | A | 0.02% | 0.02% | 0.00% | 0.00% | 0.00% | 0.00% | 0.00% | 0.00% | 0.00% |
| | C | 0.02% | 0.04% | 0.00% | 0.00% | 0.02% | 0.06% | 0.02% | 0.00% | 0.02% |
| | G | 0.00% | 0.00% | 0.00% | 0.00% | 0.00% | 0.00% | 0.00% | 0.00% | 0.00% |
| | T | 99.96% | 99.94% | 100.00% | 100.00% | 99.98% | 99.94% | 99.98% | 100.00% | 99.98% |

| HEK2-7 pNMG-362 | | 16 T | 12 T | 9 T | 8 T | 7 T | 5 T | 4 T | 3 T | 2 T |
|---|---|---|---|---|---|---|---|---|---|---|
| | A | 0.02% | 0.00% | 0.00% | 0.00% | 0.00% | 0.00% | 0.00% | 0.00% | 0.02% |
| | C | 0.00% | 0.00% | 0.00% | 0.05% | 0.00% | 0.10% | 0.00% | 0.05% | 0.02% |
| | G | 0.00% | 0.00% | 0.00% | 0.00% | 0.00% | 0.00% | 0.00% | 0.00% | 0.00% |
| | T | 99.98% | 100.00% | 100.00% | 99.95% | 100.00% | 99.90% | 100.00% | 99.95% | 99.95% |

FIGURE 111 (Continued)

HEK2-7: 3'-CCTGCAGT CAAT GAT T T GT T T T G-5'
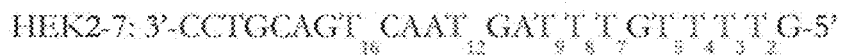

| HEK2-7 pNMG-363 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.03% | 0.00% | 0.00% | 0.00% | 0.00% | 0.00% |
| | C | 0.00% | 0.03% | 0.00% | 0.00% | 0.00% | 0.16% | 0.00% | 0.00% | 0.00% |
| | G | 0.00% | 0.00% | 0.00% | 0.00% | 0.00% | 0.00% | 0.00% | 0.00% | 0.00% |
| | T | 100.00% | 99.97% | 100.00% | 99.97% | 100.00% | 99.84% | 100.00% | 100.00% | 100.00% |

| HEK2-7 pNMG-364 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.02% | 0.00% | 0.00% | 0.00% | 0.00% | 0.00% |
| | C | 0.02% | 0.02% | 0.00% | 0.00% | 0.00% | 0.02% | 0.02% | 0.02% | 0.04% |
| | G | 0.00% | 0.00% | 0.00% | 0.00% | 0.00% | 0.00% | 0.00% | 0.00% | 0.00% |
| | T | 99.98% | 99.98% | 100.00% | 99.98% | 100.00% | 99.98% | 99.98% | 99.98% | 99.96% |

| HEK2-7 pNMG-365 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.00% | 0.00% | 0.00% | 0.00% | 0.00% | 0.01% |
| | C | 0.01% | 0.01% | 0.04% | 0.01% | 0.01% | 0.07% | 0.01% | 0.01% | 0.00% |
| | G | 0.00% | 0.00% | 0.00% | 0.00% | 0.00% | 0.00% | 0.00% | 0.00% | 0.01% |
| | T | 99.98% | 99.99% | 99.95% | 99.99% | 99.99% | 99.93% | 99.99% | 99.99% | 99.97% |

| HEK2-7 pNMG-366 | | 16 T | 12 T | 9 T | 8 T | 7 T | 5 T | 4 T | 3 T | 2 T |
|---|---|---|---|---|---|---|---|---|---|---|
| | A | 0.01% | 0.01% | 0.01% | 0.00% | 0.01% | 0.00% | 0.00% | 0.01% | 0.00% |
| | C | 0.02% | 0.02% | 0.02% | 0.04% | 0.03% | 0.07% | 0.00% | 0.02% | 0.01% |
| | G | 0.00% | 0.00% | 0.00% | 0.01% | 0.00% | 0.01% | 0.00% | 0.00% | 0.00% |
| | T | 99.98% | 99.96% | 99.97% | 99.96% | 99.97% | 99.92% | 100.00% | 99.97% | 99.99% |

| HEK2-7 pNMG-367 | | 16 T | 12 T | 9 T | 8 T | 7 T | 5 T | 4 T | 3 T | 2 T |
|---|---|---|---|---|---|---|---|---|---|---|
| | A | 0.00% | 0.01% | 0.00% | 0.00% | 0.00% | 0.00% | 0.00% | 0.00% | 0.00% |
| | C | 0.01% | 0.03% | 0.01% | 0.01% | 0.00% | 0.07% | 0.01% | 0.02% | 0.00% |
| | G | 0.00% | 0.00% | 0.00% | 0.00% | 0.00% | 0.01% | 0.00% | 0.00% | 0.00% |
| | T | 99.99% | 99.96% | 99.99% | 99.99% | 100.00% | 99.92% | 99.99% | 99.98% | 99.99% |

| HEK2-7 pNMG-368 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.01% | 0.01% | 0.00% | 0.00% | 0.00% | 0.01% |
| | C | 0.00% | 0.00% | 0.00% | 0.01% | 0.01% | 0.00% | 0.00% | 0.02% | 0.01% |
| | G | 0.00% | 0.00% | 0.00% | 0.01% | 0.00% | 0.02% | 0.00% | 0.00% | 0.00% |
| | T | 99.99% | 100.00% | 99.99% | 99.97% | 99.98% | 99.97% | 100.00% | 99.97% | 99.98% |

FIGURE 112

HEK2-10: 3'-CCATCAT T C T AT T CT T T AT GT T C-5'
                    17 16  14 12 11  9 8  7 5 3 2

| HEK2-10 pNMG-369 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.04% | 0.00% | 0.00% | 0.00% | 0.00% | 0.00% | 0.00% | 0.01% | 0.01% | 0.00% |
| | C | 0.02% | 0.01% | 0.01% | 0.14% | 0.38% | 0.31% | 0.88% | 1.27% | 7.43% | 1.02% | 0.27% |
| | G | 0.01% | 0.00% | 0.00% | 0.00% | 0.02% | 0.00% | 0.00% | 0.01% | 0.00% | 0.01% | 0.00% |
| | T | | | | | | | | | | | |

| HEK2-10 pNMG-370 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.05% | 0.00% | 0.01% | 0.01% | 0.01% | 0.00% | 0.00% | 0.01% | 0.00% | 0.01% |
| | C | 0.01% | 0.01% | 0.02% | 0.29% | 0.10% | 0.08% | 0.60% | 0.43% | 3.51% | 0.30% | 0.30% |
| | G | 0.00% | 0.00% | 0.00% | 0.00% | 0.00% | 0.00% | 0.01% | 0.00% | 0.01% | 0.00% | 0.00% |
| | T | | | | | | | | | | | |

| HEK2-10 pNMG-371 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.10% | 0.01% | 0.01% | 0.00% | 0.00% | 0.00% | 0.01% | 0.01% | 0.00% | 0.00% |
| | C | 0.01% | 0.01% | 0.01% | 0.47% | 0.20% | 0.30% | 1.12% | 1.33% | 7.23% | 0.70% | 0.54% |
| | G | 0.00% | 0.00% | 0.00% | 0.00% | 0.01% | 0.00% | 0.00% | 0.00% | 0.00% | 0.00% | 0.00% |
| | T | | | | | | | | | | | |

| HEK2-10 pNMG-380 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.01% | 0.09% | 0.00% | 0.00% | 0.01% | 0.01% | 0.00% | 0.01% | 0.00% | 0.01% | 0.00% |
| | C | 0.03% | 0.01% | 0.03% | 0.60% | 0.24% | 0.03% | 0.68% | 0.14% | 1.20% | 0.17% | 0.62% |
| | G | 0.01% | 0.00% | 0.00% | 0.00% | 0.02% | 0.00% | 0.02% | 0.01% | 0.00% | 0.00% | 0.00% |
| | T | | | | | | | | | | | |

| HEK2-10 pNMG-381 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.16% | 0.00% | 0.00% | 0.04% | 0.03% | 0.00% | 0.01% | 0.01% | 0.01% | 0.01% |
| | C | 0.01% | 0.00% | 0.06% | 0.52% | 0.12% | 0.01% | 0.58% | 0.11% | 0.21% | 0.04% | 0.42% |
| | G | 0.01% | 0.00% | 0.00% | 0.00% | 0.02% | 0.00% | 0.02% | 0.03% | 0.00% | 0.00% | 0.00% |
| | T | | | | | | | | | | | |

| HEK2-10 pNMG-382 | | 17 | 16 | 14 | 12 | 11 | 9 | 8 | 7 | 5 | 3 | 2 |
|---|---|---|---|---|---|---|---|---|---|---|---|---|
| | | T | T | T | T | T | T | T | T | T | T | T |
| | A | 0.00% | 0.07% | 0.01% | 0.00% | 0.00% | 0.00% | 0.01% | 0.00% | 0.00% | 0.01% | 0.01% |
| | C | 0.01% | 0.01% | 0.01% | 0.28% | 1.06% | 0.13% | 0.47% | 0.76% | 1.37% | 0.17% | 0.28% |
| | G | 0.01% | 0.00% | 0.00% | 0.00% | 0.01% | 0.00% | 0.00% | 0.00% | 0.00% | 0.00% | 0.00% |
| | T | | | | | | | | | | | |

FIGURE 112 (Continued)

HEK2-10: 3'-CCATCAT$_{17}$T$_{16}$C T$_{14}$AT$_{12}$T$_{11}$CT$_{9}$T$_{8}$T$_{7}$AT$_{5}$GT$_{3}$T$_{2}$C-5'

| HEK2-10 pNMG-363 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.01% | 0.02% | 0.00% | 0.01% | 0.01% | 0.00% | 0.00% | 0.01% | 0.01% | 0.00% | 0.01% |
| | C | 0.02% | 0.01% | 0.01% | 0.15% | 1.24% | 0.13% | 0.30% | 0.35% | 3.03% | 0.41% | 0.23% |
| | G | 0.01% | 0.00% | 0.00% | 0.01% | 0.01% | 0.00% | 0.00% | 0.00% | 0.00% | 0.00% | 0.00% |
| | T | 99.97% | 99.97% | 99.98% | 99.83% | 98.74% | 99.87% | 99.69% | 99.64% | 96.96% | 99.58% | 99.76% |

| HEK2-10 pNMG-364 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.07% | 0.01% | 0.00% | 0.00% | 0.00% | 0.01% | 0.00% | 0.00% | 0.00% | 0.00% |
| | C | 0.02% | 0.01% | 0.01% | 0.38% | 0.04% | 0.01% | 0.39% | 0.04% | 0.49% | 0.14% | 0.36% |
| | G | 0.01% | 0.00% | 0.00% | 0.00% | 0.00% | 0.00% | 0.00% | 0.00% | 0.00% | 0.00% | 0.00% |
| | T | 99.97% | 99.92% | 99.98% | 99.61% | 99.95% | 99.98% | 99.60% | 99.95% | 99.51% | 99.85% | 99.64% |

| HEK2-10 pNMG-365 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.12% | 0.00% | 0.00% | 0.00% | 0.00% | 0.00% | 0.00% | 0.01% | 0.01% | 0.01% |
| | C | 0.01% | 0.01% | 0.02% | 0.40% | 1.68% | 0.08% | 0.48% | 0.13% | 1.53% | 0.24% | 0.40% |
| | G | 0.00% | 0.00% | 0.00% | 0.00% | 0.00% | 0.00% | 0.01% | 0.00% | 0.00% | 0.00% | 0.00% |
| | T | 99.98% | 99.87% | 99.97% | 99.60% | 98.31% | 99.91% | 99.51% | 99.86% | 98.45% | 99.75% | 99.59% |

| HEK2-10 pNMG-366 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.01% | 0.01% | 0.00% | 0.00% | 0.01% | 0.00% | 0.00% | 0.01% | 0.00% |
| | C | 0.01% | 0.01% | 0.01% | 0.08% | 0.28% | 0.15% | 0.35% | 0.68% | 2.82% | 0.61% | 0.31% |
| | G | 0.01% | 0.00% | 0.00% | 0.00% | 0.00% | 0.00% | 0.00% | 0.00% | 0.00% | 0.00% | 0.00% |
| | T | 99.98% | 99.97% | 99.98% | 99.91% | 99.71% | 99.85% | 99.64% | 99.31% | 97.17% | 99.38% | 99.69% |

| HEK2-10 pNMG-367 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.01% | 0.07% | 0.01% | 0.01% | 0.00% | 0.00% | 0.00% | 0.00% | 0.00% | 0.01% | 0.01% |
| | C | 0.01% | 0.01% | 0.01% | 0.38% | 0.84% | 0.11% | 0.52% | 0.26% | 2.27% | 0.27% | 0.51% |
| | G | 0.00% | 0.00% | 0.00% | 0.00% | 0.01% | 0.00% | 0.00% | 0.00% | 0.00% | 0.00% | 0.00% |
| | T | 99.98% | 99.92% | 99.98% | 99.60% | 99.15% | 99.89% | 99.47% | 99.74% | 97.73% | 99.72% | 99.48% |

| HEK2-10 pNMG-368 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.01% | 0.06% | 0.01% | 0.00% | 0.01% | 0.00% | 0.00% | 0.00% | 0.01% | 0.00% | 0.01% |
| | C | 0.02% | 0.01% | 0.01% | 0.22% | 0.01% | 0.01% | 0.21% | 0.01% | 0.02% | 0.01% | 0.19% |
| | G | 0.01% | 0.00% | 0.00% | 0.00% | 0.01% | 0.00% | 0.01% | 0.00% | 0.00% | 0.00% | 0.00% |
| | T | 99.97% | 99.94% | 99.98% | 99.78% | 99.98% | 99.98% | 99.78% | 99.98% | 99.97% | 99.99% | 99.79% |

FANCF 5'-GGA$_3$ATCCCTTCTGCA$_{15}$GCA$_{18}$CCTGG-3'

FIGURE 115

Hek-2 site: 3'-CCCGCAGT$_{16}$CT$_{14}$AT$_{12}$GCT$_9$T$_8$T$_7$G T$_5$GT$_3$T$_2$C-5'

| HEK2 pNMG-370/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.02% | 0.00% | 0.01% | 0.00% | 0.04% | 0.01% | 0.00% |
| | C | 0.01% | 0.03% | 0.01% | 0.34% | 0.67% | 0.44% | | 1.20% | 0.10% |
| | G | 0.00% | 0.00% | 0.00% | 0.00% | 0.00% | 0.00% | 0.03% | 0.00% | 0.00% |
| | T | 99.98% | 99.96% | 99.97% | 99.65% | 99.32% | 99.56% | | 98.79% | 99.89% |

| HEK2 pNMG-371/299 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.01% | 0.01% | 0.00% |
| | C | 0.01% | 0.02% | 0.03% | 0.73% | 1.20% | 1.40% | | 3.91% | 0.11% |
| | G | 0.01% | 0.00% | 0.00% | 0.00% | 0.01% | 0.00% | 0.01% | 0.00% | 0.00% |
| | T | 99.98% | 99.97% | 99.96% | 99.26% | 98.78% | 98.59% | | 96.07% | 99.89% |

| HEK2 pNMG-382/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.00% | 0.00% | 0.00% |
| | C | 0.01% | 0.01% | 0.03% | 0.02% | 0.23% | 0.31% | | 0.55% | 0.06% |
| | G | 0.01% | 0.00% | 0.00% | 0.00% | 0.00% | 0.00% | 0.02% | 0.00% | 0.00% |
| | T | 99.97% | 99.98% | 99.96% | 99.98% | 99.76% | 99.69% | | 99.45% | 99.93% |

| HEK2 pNMG-383/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.02% | 0.01% | 0.00% |
| | C | 0.01% | 0.02% | 0.02% | 0.10% | 0.07% | 0.13% | | 0.29% | 0.05% |
| | G | 0.01% | 0.00% | 0.00% | 0.00% | 0.01% | 0.00% | 0.01% | 0.00% | 0.00% |
| | T | 99.98% | 99.98% | 99.97% | 99.89% | 99.91% | 99.87% | | 99.69% | 99.94% |

| HEK2 pNMG-384/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.02% | 0.03% | 0.03% | 0.04% | 0.05% | 0.11% | | 0.12% | 0.03% |
| | G | 0.01% | 0.00% | 0.00% | 0.00% | 0.00% | 0.00% | 0.00% | 0.00% | 0.00% |
| | T | 99.97% | 99.97% | 99.97% | 99.95% | 99.94% | 99.88% | | 99.88% | 99.97% |

| HEK2 pNMG-385/299 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.01% | 0.00% | 0.00% |
| | C | 0.01% | 0.02% | 0.02% | 0.01% | 0.06% | 0.09% | | 0.12% | 0.05% |
| | G | 0.01% | 0.00% | 0.00% | 0.00% | 0.01% | 0.00% | 0.01% | 0.00% | 0.00% |
| | T | 99.99% | 99.98% | 99.98% | 99.99% | 99.92% | 99.91% | | 99.88% | 99.95% |

| HEK2 pNMG-386/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.07% | 0.44% | 0.13% | | 0.80% | 0.04% |
| | G | 0.01% | 0.00% | 0.00% | 0.00% | 0.01% | 0.00% | 0.01% | 0.00% | 0.00% |
| | T | 99.97% | 99.98% | 99.98% | 99.93% | 99.54% | 99.87% | | 99.20% | 99.96% |

FIGURE 115 (Continued)

Hek-2 site: 3'-CCCGCAGT$_{16}$CT$_{14}$AT$_{12}$GCT$_9$T$_8$T$_7$G T$_5$GT$_3$T$_2$C-5'

| HEK2 pNMG-387/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.02% | 0.00% | 0.01% | 0.00% | 0.00% |
| | C | 0.01% | 0.02% | 0.02% | 0.05% | 0.18% | 0.13% | | 0.63% | 0.02% |
| | G | 0.00% | 0.00% | 0.00% | 0.00% | 0.01% | 0.00% | 0.01% | 0.00% | 0.00% |
| | T | 99.99% | 99.97% | 99.97% | 99.94% | 99.79% | 99.86% | | 99.37% | 99.98% |

| HEK2 pNMG-388/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.00% | 0.00% | 0.01% | 0.00% | 0.00% |
| | C | 0.01% | 0.02% | 0.01% | 0.04% | 0.18% | 0.13% | | 0.55% | 0.07% |
| | G | 0.00% | 0.00% | 0.00% | 0.00% | 0.01% | 0.00% | 0.01% | 0.00% | 0.00% |
| | T | 99.99% | 99.97% | 99.98% | 99.95% | 99.81% | 99.87% | | 99.44% | 99.93% |

| HEK2 pNMG-389/299 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.01% | 0.02% | 0.00% | 0.02% | 0.00% | 0.00% |
| | C | 0.02% | 0.01% | 0.01% | 0.09% | 0.19% | 0.22% | | 0.40% | 0.07% |
| | G | 0.00% | 0.00% | 0.00% | 0.00% | 0.00% | 0.01% | 0.01% | 0.00% | 0.00% |
| | T | 99.98% | 99.98% | 99.98% | 99.89% | 99.79% | 99.77% | | 99.60% | 99.92% |

| HEK2 pNMG-370/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.01% | 0.03% | 0.01% | 0.01% |
| | C | 0.01% | 0.02% | 0.01% | 0.90% | 10.56% | 1.26% | | | 0.73% |
| | G | 0.01% | 0.00% | 0.00% | 0.00% | 0.05% | 0.00% | 0.00% | 0.00% | 0.00% |
| | T | 99.98% | 99.97% | 99.98% | 99.09% | 89.38% | 98.73% | | | 99.26% |

| HEK2 pNMG-371/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.05% | 0.02% | 0.02% | 0.03% | 0.00% |
| | C | 0.01% | 0.02% | 0.04% | 1.52% | | 4.44% | | | 1.66% |
| | G | 0.01% | 0.00% | 0.00% | 0.00% | 0.03% | 0.00% | 0.03% | 0.00% | 0.00% |
| | T | 99.98% | 99.98% | 99.95% | 98.48% | 86.02% | 95.54% | | | 98.33% |

| HEK2 pNMG-382/301 | | 16 T | 14 T | 12 T | 9 T | 8 T | 7 T | 5 T | 3 T | 2 T |
|---|---|---|---|---|---|---|---|---|---|---|
| | A | 0.00% | 0.01% | 0.01% | 0.00% | 0.01% | 0.00% | 0.00% | 0.00% | 0.00% |
| | C | 0.01% | 0.01% | 0.02% | 0.13% | 6.00% | 0.73% | | 12.15% | 0.80% |
| | G | 0.01% | 0.00% | 0.00% | 0.00% | 0.05% | 0.00% | 0.00% | 0.03% | 0.00% |
| | T | 99.98% | 99.98% | 99.97% | 99.87% | 93.94% | 99.27% | | 87.82% | 99.20% |

| HEK2 pNMG-383/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.01% | 0.01% | 0.01% | 0.00% |
| | C | 0.01% | 0.02% | 0.01% | 0.51% | 3.02% | 0.62% | | 10.65% | 0.30% |
| | G | 0.00% | 0.00% | 0.00% | 0.00% | 0.01% | 0.00% | 0.00% | 0.00% | 0.00% |
| | T | 99.98% | 99.98% | 99.98% | 99.49% | 96.97% | 99.37% | | 89.34% | 99.69% |

FIGURE 115 (Continued)

Hek-2 site: 3'-CCCGCAGT₁₆CT₁₄AT₁₂GCT₉T₈T₇G T₅GT₃T₂C-5'

| HEK2 pNMG-384/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.02% | 0.01% | 0.00% | 0.00% | 0.01% | 0.00% | 0.00% |
| | C | 0.01% | 0.02% | 0.01% | 0.42% | 2.72% | 0.18% | 13.40% | 6.88% | 0.12% |
| | G | 0.01% | 0.00% | 0.00% | 0.00% | 0.03% | 0.00% | 0.00% | 0.00% | 0.00% |
| | T | 99.98% | 99.98% | 99.97% | 99.58% | 97.25% | 99.82% | 86.59% | 93.11% | 99.87% |

| HEK2 pNMG-385/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.00% | 0.00% | 0.01% |
| | C | 0.00% | 0.02% | 0.01% | 0.06% | 0.43% | 0.06% | 8.73% | 2.84% | 0.11% |
| | G | 0.01% | 0.00% | 0.00% | 0.00% | 0.01% | 0.00% | 0.00% | 0.00% | 0.00% |
| | T | 99.99% | 99.98% | 99.98% | 99.93% | 99.56% | 99.94% | 91.27% | 97.16% | 99.88% |

| HEK2 pNMG-386/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.02% | 0.01% | 0.64% | 2.94% | 0.28% | 13.41% | 7.73% | 0.23% |
| | G | 0.05% | 0.00% | 0.00% | 0.00% | 0.01% | 0.00% | 0.00% | 0.01% | 0.00% |
| | T | 99.94% | 99.98% | 99.98% | 99.35% | 97.04% | 99.72% | 86.58% | 92.26% | 99.76% |

| HEK2 pNMG-387/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.01% | 0.00% | 0.01% | 0.00% | 0.00% |
| | C | 0.01% | 0.01% | 0.04% | 0.13% | 3.90% | 0.44% | 15.00% | 10.33% | 0.57% |
| | G | 0.00% | 0.00% | 0.00% | 0.00% | 0.01% | 0.00% | 0.01% | 0.00% | 0.00% |
| | T | 99.99% | 99.98% | 99.95% | 99.86% | 96.08% | 99.56% | 84.98% | 89.66% | 99.43% |

| HEK2 pNMG-388/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.00% | 0.01% | 0.02% | 0.12% | 4.98% | 0.61% | 20.00% | 12.33% | 0.70% |
| | G | 0.00% | 0.00% | 0.00% | 0.00% | 0.01% | 0.00% | 0.00% | 0.00% | 0.00% |
| | T | 99.99% | 99.98% | 99.97% | 99.88% | 95.00% | 99.39% | 79.99% | 87.67% | 99.29% |

| HEK2 pNMG-389/301 | | 16 T | 14 T | 12 T | 9 T | 8 T | 7 T | 5 T | 3 T | 2 T |
|---|---|---|---|---|---|---|---|---|---|---|
| | A | 0.00% | 0.00% | 0.01% | 0.00% | 0.02% | 0.01% | 0.01% | 0.01% | 0.01% |
| | C | 0.01% | 0.02% | 0.01% | 0.27% | 9.95% | 0.60% | 17.49% | 9.82% | 0.86% |
| | G | 0.01% | 0.00% | 0.00% | 0.00% | 0.01% | 0.01% | 0.00% | 0.00% | 0.00% |
| | T | 99.98% | 99.98% | 99.98% | 99.73% | 90.02% | 99.38% | 82.50% | 90.17% | 99.13% |

FIGURE 116

Hek2-2 site: 5'-GA₁A₂TA₃CTA₄A₅GCA₆TA₇GA₈CTCCAGG-3'

| HEK2-2 pNMG-370 | 2 | 3 | 5 | 8 | 9 | 12 | 14 | 16 |
|---|---|---|---|---|---|---|---|---|
| | A | A | A | A | A | A | A | A |
| A | 99.81% | 99.80% | — | 99.53% | 99.93% | 99.97% | 99.99% | 99.99% |
| C | 0.02% | 0.01% | 0.01% | 0.01% | 0.01% | 0.01% | 0.01% | 0.00% |
| G | 0.14% | 0.19% | — | 0.46% | 0.06% | 0.01% | 0.00% | 0.01% |
| T | 0.02% | 0.01% | 0.01% | 0.00% | 0.00% | 0.01% | 0.01% | 0.00% |

| HEK2-2 pNMG-371 | 2 | 3 | 5 | 8 | 9 | 12 | 14 | 16 |
|---|---|---|---|---|---|---|---|---|
| | A | A | A | A | A | A | A | A |
| A | 99.47% | 99.28% | — | 99.33% | 99.65% | 99.98% | 99.99% | 100.00% |
| C | 0.02% | 0.00% | 0.00% | 0.00% | 0.00% | 0.00% | 0.00% | 0.00% |
| G | 0.50% | 0.71% | — | 0.66% | 0.35% | 0.01% | 0.01% | 0.00% |
| T | 0.01% | 0.01% | 0.01% | 0.00% | 0.00% | 0.01% | 0.00% | 0.00% |

| HEK2-2 pNMG-382 | 2 | 3 | 5 | 8 | 9 | 12 | 14 | 16 |
|---|---|---|---|---|---|---|---|---|
| | A | A | A | A | A | A | A | A |
| A | 99.91% | 99.88% | — | 99.85% | 99.97% | 99.97% | 99.95% | 99.97% |
| C | 0.03% | 0.01% | 0.01% | 0.03% | 0.02% | 0.02% | 0.04% | 0.01% |
| G | 0.05% | 0.10% | — | 0.12% | 0.01% | 0.01% | 0.01% | 0.00% |
| T | 0.01% | 0.00% | 0.01% | 0.00% | 0.01% | 0.00% | 0.00% | 0.02% |

| HEK2-2 pNMG-383 | 2 | 3 | 5 | 8 | 9 | 12 | 14 | 16 |
|---|---|---|---|---|---|---|---|---|
| | A | A | A | A | A | A | A | A |
| A | 99.91% | 99.97% | — | 99.93% | 99.95% | 99.98% | 99.99% | 99.98% |
| C | 0.01% | 0.00% | 0.00% | 0.00% | 0.00% | 0.00% | 0.00% | 0.00% |
| G | 0.07% | 0.03% | 23.84% | 0.07% | 0.04% | 0.01% | 0.01% | 0.01% |
| T | 0.00% | 0.00% | 0.01% | 0.00% | 0.00% | 0.01% | 0.01% | 0.00% |

| HEK2-2 pNMG-384 | 2 | 3 | 5 | 8 | 9 | 12 | 14 | 16 |
|---|---|---|---|---|---|---|---|---|
| | A | A | A | A | A | A | A | A |
| A | 99.92% | 99.99% | — | 99.96% | 99.95% | 99.97% | 99.97% | 99.99% |
| C | 0.02% | 0.01% | 0.01% | 0.01% | 0.01% | 0.01% | 0.01% | 0.01% |
| G | 0.05% | 0.00% | 21.83% | 0.03% | 0.04% | 0.01% | 0.01% | 0.00% |
| T | 0.01% | 0.00% | 0.01% | 0.00% | 0.00% | 0.01% | 0.00% | 0.00% |

FIGURE 116 (Continued)

Hek2-2 site: 5'-GA₁A₂TA₃CTA₄A₅GCA₆TA₇GA₈CTCCAGG-3'

| HEK2-2 pNMG-385 | | 2 A | 3 A | 5 A | 8 A | 9 A | 12 A | 14 A | 16 A |
|---|---|---|---|---|---|---|---|---|---|
| | A | 99.95% | 99.99% | 88.71% | 99.96% | 99.99% | 99.99% | 99.99% | 99.99% |
| | C | 0.01% | 0.00% | 0.00% | 0.00% | 0.00% | 0.00% | 0.00% | 0.00% |
| | G | 0.04% | 0.01% | 11.29% | 0.03% | 0.01% | 0.00% | 0.01% | 0.00% |
| | T | 0.00% | 0.00% | 0.01% | 0.00% | 0.00% | 0.00% | 0.00% | 0.00% |

| HEK2-2 pNMG-386 | | 2 A | 3 A | 5 A | 8 A | 9 A | 12 A | 14 A | 16 A |
|---|---|---|---|---|---|---|---|---|---|
| | A | 99.92% | 99.95% | 79.04% | 99.88% | 99.96% | 99.95% | 99.97% | 99.98% |
| | C | 0.04% | 0.02% | 0.02% | 0.04% | 0.03% | 0.04% | 0.02% | 0.02% |
| | G | 0.03% | 0.02% | 20.94% | 0.08% | 0.00% | 0.00% | 0.01% | 0.00% |
| | T | 0.01% | 0.01% | 0.01% | 0.00% | 0.00% | 0.01% | 0.00% | 0.00% |

| HEK2-2 pNMG-387 | | 2 A | 3 A | 5 A | 8 A | 9 A | 12 A | 14 A | 16 A |
|---|---|---|---|---|---|---|---|---|---|
| | A | 99.86% | 99.93% | 78.43% | 99.82% | 99.94% | 99.98% | 99.99% | 99.99% |
| | C | 0.02% | 0.00% | 0.00% | 0.00% | 0.00% | 0.00% | 0.00% | 0.00% |
| | G | 0.11% | 0.06% | 21.56% | 0.17% | 0.05% | 0.01% | 0.01% | 0.01% |
| | T | 0.00% | 0.00% | 0.01% | 0.00% | 0.01% | 0.01% | 0.00% | 0.01% |

| HEK2-2 pNMG-388 | | 2 A | 3 A | 5 A | 8 A | 9 A | 12 A | 14 A | 16 A |
|---|---|---|---|---|---|---|---|---|---|
| | A | 99.87% | 99.88% | 76.34% | 99.90% | 99.98% | 99.98% | 99.98% | 99.98% |
| | C | 0.01% | 0.00% | 0.01% | 0.00% | 0.00% | 0.00% | 0.02% | 0.00% |
| | G | 0.12% | 0.12% | 23.64% | 0.09% | 0.01% | 0.01% | 0.00% | 0.00% |
| | T | 0.01% | 0.00% | 0.01% | 0.00% | 0.01% | 0.01% | 0.00% | 0.02% |

| HEK2-2 pNMG-389 | | 2 A | 3 A | 5 A | 8 A | 9 A | 12 A | 14 A | 16 A |
|---|---|---|---|---|---|---|---|---|---|
| | A | 99.82% | 99.95% | 76.62% | 99.90% | 99.97% | 99.99% | 99.98% | 99.99% |
| | C | 0.01% | 0.00% | 0.00% | 0.00% | 0.00% | 0.00% | 0.00% | 0.00% |
| | G | 0.16% | 0.04% | 23.37% | 0.10% | 0.02% | 0.01% | 0.01% | 0.00% |
| | T | 0.00% | 0.01% | 0.01% | 0.00% | 0.00% | 0.01% | 0.00% | 0.01% |

FIGURE 117

Hek 2-3 site: 5'-GTA₃A₄A₅CA₇A₈A₉GCA₁₂TA₁₄GA₁₆CTGAGGG -3'

| HEK2-3 pNMG-370 | | 3<br>A | 4<br>A | 5<br>A | 7<br>A | 8<br>A | 9<br>A | 12<br>A | 14<br>A | 16<br>A |
|---|---|---|---|---|---|---|---|---|---|---|
| | A | 99.86% | 99.81% | 89.59% | 99.89% | 99.50% | 99.67% | 99.97% | 99.97% | 99.99% |
| | C | 0.00% | 0.01% | 0.01% | 0.01% | 0.01% | 0.14% | 0.01% | 0.02% | 0.00% |
| | G | 0.12% | 0.17% | 10.39% | 0.10% | 0.48% | 0.19% | 0.02% | 0.01% | 0.00% |
| | T | 0.01% | 0.01% | 0.01% | 0.01% | 0.01% | 0.00% | 0.01% | 0.00% | 0.01% |

| HEK2-3 pNMG-371 | | 3<br>A | 4<br>A | 5<br>A | 7<br>A | 8<br>A | 9<br>A | 12<br>A | 14<br>A | 16<br>A |
|---|---|---|---|---|---|---|---|---|---|---|
| | A | 99.61% | 98.90% | 99.99% | 99.00% | 98.38% | 99.18% | 99.94% | 99.97% | 99.99% |
| | C | 0.00% | 0.01% | 0.00% | 0.00% | 0.00% | 0.13% | 0.00% | 0.01% | 0.00% |
| | G | 0.39% | 1.08% | 99.99% | 1.00% | 1.60% | 0.69% | 0.04% | 0.02% | 0.00% |
| | T | 0.00% | 0.01% | 0.01% | 0.00% | 0.01% | 0.00% | 0.02% | 0.00% | 0.01% |

| HEK2-3 pNMG-382 | | 3<br>A | 4<br>A | 5<br>A | 7<br>A | 8<br>A | 9<br>A | 12<br>A | 14<br>A | 16<br>A |
|---|---|---|---|---|---|---|---|---|---|---|
| | A | 0.00% | 0.00% | 0.01% | 0.00% | 0.01% | 0.00% | 0.00% | 0.00% | 0.00% |
| | C | 0.01% | 0.01% | 0.03% | 0.02% | 0.23% | 0.31% | 99.99% | 0.55% | 0.06% |
| | G | 0.01% | 0.00% | 0.00% | 0.00% | 0.00% | 0.00% | 0.02% | 0.00% | 0.00% |
| | T | 99.97% | 99.98% | 99.96% | 99.98% | 99.76% | 99.69% | 99.99% | 99.45% | 99.93% |

| HEK2-3 pNMG-383 | | 3<br>A | 4<br>A | 5<br>A | 7<br>A | 8<br>A | 9<br>A | 12<br>A | 14<br>A | 16<br>A |
|---|---|---|---|---|---|---|---|---|---|---|
| | A | 0.00% | 0.00% | 0.01% | 0.00% | 0.01% | 0.00% | 0.02% | 0.01% | 0.00% |
| | C | 0.01% | 0.02% | 0.02% | 0.10% | 0.07% | 0.13% | 99.99% | 0.29% | 0.05% |
| | G | 0.01% | 0.00% | 0.00% | 0.00% | 0.01% | 0.00% | 0.01% | 0.00% | 0.00% |
| | T | 99.98% | 99.98% | 99.97% | 99.89% | 99.91% | 99.87% | 99.99% | 99.69% | 99.94% |

| HEK2-3 pNMG-384 | | 3<br>A | 4<br>A | 5<br>A | 7<br>A | 8<br>A | 9<br>A | 12<br>A | 14<br>A | 16<br>A |
|---|---|---|---|---|---|---|---|---|---|---|
| | A | 0.00% | 0.00% | 0.00% | 0.00% | 0.01% | 0.00% | 0.01% | 0.00% | 0.01% |
| | C | 0.02% | 0.03% | 0.03% | 0.04% | 0.05% | 0.11% | 99.99% | 0.12% | 0.03% |
| | G | 0.01% | 0.00% | 0.00% | 0.00% | 0.00% | 0.00% | 0.00% | 0.00% | 0.00% |
| | T | 99.97% | 99.97% | 99.97% | 99.95% | 99.94% | 99.89% | 99.99% | 99.88% | 99.97% |

| HEK2-3 pNMG-385 | | 3<br>A | 4<br>A | 5<br>A | 7<br>A | 8<br>A | 9<br>A | 12<br>A | 14<br>A | 16<br>A |
|---|---|---|---|---|---|---|---|---|---|---|
| | A | 0.00% | 0.01% | 0.01% | 0.00% | 0.01% | 0.00% | 0.01% | 0.00% | 0.00% |
| | C | 0.01% | 0.02% | 0.02% | 0.01% | 0.06% | 0.09% | 99.99% | 0.12% | 0.05% |
| | G | 0.01% | 0.00% | 0.00% | 0.00% | 0.01% | 0.00% | 0.01% | 0.00% | 0.00% |
| | T | 99.98% | 99.98% | 99.98% | 99.99% | 99.93% | 99.91% | 99.99% | 99.88% | 99.95% |

FIGURE 117 (Continued)

Hek 2-3 site: 5'-GTA$_3$A$_4$A$_5$CA$_7$A$_8$A$_9$GCA$_{12}$TA$_{14}$GA$_{16}$CTGAGGG -3'

| HEK2-3 pNMG-386 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.01% | 0.00% | 0.01% | 0.00% | 0.01% | 0.00% | 0.00% |
| | C | 0.01% | 0.02% | 0.01% | 0.07% | 0.44% | 0.13% | | 0.80% | 0.04% |
| | G | 0.01% | 0.00% | 0.00% | 0.00% | 0.01% | 0.00% | 0.01% | 0.00% | 0.00% |
| | T | 99.97% | 99.98% | 99.98% | 99.93% | 99.54% | 99.87% | | 99.20% | 99.96% |

| HEK2-3 pNMG-387 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.01% | 0.00% | 0.02% | 0.00% | 0.01% | 0.00% | 0.00% |
| | C | 0.01% | 0.02% | 0.02% | 0.05% | 0.18% | 0.13% | | 0.63% | 0.02% |
| | G | 0.00% | 0.00% | 0.00% | 0.00% | 0.01% | 0.00% | 0.01% | 0.00% | 0.00% |
| | T | 99.98% | 99.97% | 99.97% | 99.94% | 99.79% | 99.86% | | 99.37% | 99.98% |

| HEK2-3 pNMG-388 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.01% | 0.00% | 0.00% | 0.00% | 0.01% | 0.00% | 0.00% |
| | C | 0.01% | 0.02% | 0.01% | 0.04% | 0.18% | 0.13% | | 0.55% | 0.07% |
| | G | 0.00% | 0.00% | 0.00% | 0.00% | 0.01% | 0.00% | 0.01% | 0.00% | 0.00% |
| | T | 99.99% | 99.97% | 99.98% | 99.95% | 99.81% | 99.87% | | 99.44% | 99.93% |

| HEK2-3 pNMG-389 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 0.00% | 0.00% | 0.00% | 0.01% | 0.02% | 0.00% | 0.02% | 0.00% | 0.00% |
| | C | 0.02% | 0.01% | 0.01% | 0.09% | 0.19% | 0.22% | | 0.40% | 0.07% |
| | G | 0.00% | 0.00% | 0.00% | 0.00% | 0.00% | 0.01% | 0.01% | 0.00% | 0.00% |
| | T | 99.98% | 99.98% | 99.99% | 99.89% | 99.79% | 99.77% | | 99.60% | 99.92% |

FIGURE 118

HEK2-6- 5'-GA$_2$A$_3$GA$_5$CCA$_8$A$_9$GGA$_{12}$TA$_{14}$GA$_{16}$CTGCTGG-3'

| HEK2-6 pNMG-370 | | 2 | 3 | 5 | 8 | 9 | 12 | 14 | 16 |
|---|---|---|---|---|---|---|---|---|---|
| | | A | A | A | A | A | A | A | A |
| | A | 99.96% | 99.94% | 95.58% | 99.77% | 99.84% | 99.96% | 99.98% | 99.97% |
| | C | 0.00% | 0.01% | 0.01% | 0.01% | 0.01% | 0.01% | 0.00% | 0.02% |
| | G | 0.03% | 0.04% | 4.40% | 0.21% | 0.14% | 0.02% | 0.02% | 0.01% |
| | T | 0.01% | 0.01% | 0.01% | 0.01% | 0.02% | 0.01% | 0.01% | 0.01% |

| HEK2-6 pNMG-371 | | 2 | 3 | 5 | 8 | 9 | 12 | 14 | 16 |
|---|---|---|---|---|---|---|---|---|---|
| | | A | A | A | A | A | A | A | A |
| | A | 99.95% | 99.91% | 92.37% | 99.60% | 99.63% | 99.98% | 99.99% | 99.99% |
| | C | 0.00% | 0.00% | 0.00% | 0.00% | 0.00% | 0.00% | 0.00% | 0.01% |
| | G | 0.04% | 0.08% | 7.61% | 0.39% | 0.35% | 0.01% | 0.01% | 0.00% |
| | T | 0.01% | 0.01% | 0.02% | 0.01% | 0.01% | 0.00% | 0.01% | 0.00% |

| HEK2-6 pNMG-382 | | 2 | 3 | 5 | 8 | 9 | 12 | 14 | 16 |
|---|---|---|---|---|---|---|---|---|---|
| | | A | A | A | A | A | A | A | A |
| | A | 99.97% | 99.97% | 95.39% | 99.88% | 99.90% | 99.99% | 99.99% | 99.96% |
| | C | 0.00% | 0.01% | 0.01% | 0.01% | 0.01% | 0.00% | 0.00% | 0.01% |
| | G | 0.03% | 0.01% | 4.59% | 0.10% | 0.08% | 0.01% | 0.00% | 0.02% |
| | T | 0.01% | 0.01% | 0.01% | 0.01% | 0.01% | 0.00% | 0.01% | 0.01% |

| HEK2-6 pNMG-383 | | 2 | 3 | 5 | 8 | 9 | 12 | 14 | 16 |
|---|---|---|---|---|---|---|---|---|---|
| | | A | A | A | A | A | A | A | A |
| | A | 99.97% | 99.97% | 94.48% | 99.97% | 99.90% | 99.94% | 99.97% | 99.98% |
| | C | 0.00% | 0.01% | 0.00% | 0.00% | 0.01% | 0.00% | 0.01% | 0.01% |
| | G | 0.02% | 0.01% | 5.50% | 0.03% | 0.07% | 0.04% | 0.01% | 0.00% |
| | T | 0.00% | 0.01% | 0.02% | 0.00% | 0.02% | 0.01% | 0.01% | 0.01% |

| HEK2-6 pNMG-384 | | 2 | 3 | 5 | 8 | 9 | 12 | 14 | 16 |
|---|---|---|---|---|---|---|---|---|---|
| | | A | A | A | A | A | A | A | A |
| | A | 99.96% | 99.97% | 97.20% | 99.98% | 99.94% | 99.97% | 99.98% | 99.97% |
| | C | 0.00% | 0.01% | 0.00% | 0.00% | 0.01% | 0.01% | 0.00% | 0.01% |
| | G | 0.03% | 0.01% | 2.79% | 0.01% | 0.04% | 0.01% | 0.01% | 0.01% |
| | T | 0.00% | 0.01% | 0.01% | 0.00% | 0.02% | 0.01% | 0.01% | 0.00% |

FIGURE 118 (Continued)

HEK2-6- 5'-GA$_2$A$_3$GA$_5$CCA$_8$A$_9$GGA$_{12}$TA$_{14}$GA$_{16}$CTGCTGG-3'

| HEK2-6 pNMG-385 | | 2 | 3 | 5 | 8 | 9 | 12 | 14 | 16 |
|---|---|---|---|---|---|---|---|---|---|
| | | A | A | A | A | A | A | A | A |
| | A | 99.96% | 99.97% | 98.54% | 99.98% | 99.97% | 99.97% | 99.95% | 99.98% |
| | C | 0.00% | 0.01% | 0.01% | 0.00% | 0.01% | 0.00% | 0.01% | 0.00% |
| | G | 0.02% | 0.01% | 1.45% | 0.01% | 0.02% | 0.01% | 0.03% | 0.01% |
| | T | 0.01% | 0.01% | 0.01% | 0.01% | 0.00% | 0.02% | 0.01% | 0.01% |

| HEK2-6 pNMG-386 | | 2 | 3 | 5 | 8 | 9 | 12 | 14 | 16 |
|---|---|---|---|---|---|---|---|---|---|
| | | A | A | A | A | A | A | A | A |
| | A | 99.98% | 99.97% | 97.56% | 99.95% | 99.93% | 99.95% | 99.96% | 99.97% |
| | C | 0.01% | 0.01% | 0.01% | 0.02% | 0.02% | 0.01% | 0.01% | 0.02% |
| | G | 0.01% | 0.01% | 2.41% | 0.02% | 0.04% | 0.03% | 0.02% | 0.00% |
| | T | 0.00% | 0.01% | 0.01% | 0.01% | 0.01% | 0.00% | 0.02% | 0.00% |

| HEK2-6 pNMG-387 | | 2 | 3 | 5 | 8 | 9 | 12 | 14 | 16 |
|---|---|---|---|---|---|---|---|---|---|
| | | A | A | A | A | A | A | A | A |
| | A | 99.93% | 99.97% | 97.46% | 99.94% | 99.97% | 99.98% | 99.97% | 99.98% |
| | C | 0.01% | 0.01% | 0.00% | 0.01% | 0.01% | 0.00% | 0.00% | 0.01% |
| | G | 0.05% | 0.01% | 2.53% | 0.05% | 0.02% | 0.01% | 0.01% | 0.01% |
| | T | 0.01% | 0.01% | 0.01% | 0.00% | 0.01% | 0.01% | 0.01% | 0.00% |

| HEK2-6 pNMG-388 | | 2 | 3 | 5 | 8 | 9 | 12 | 14 | 16 |
|---|---|---|---|---|---|---|---|---|---|
| | | A | A | A | A | A | A | A | A |
| | A | 99.97% | 99.98% | 96.81% | 99.94% | 99.90% | 99.94% | 99.99% | 99.99% |
| | C | 0.00% | 0.01% | 0.01% | 0.00% | 0.00% | 0.00% | 0.00% | 0.00% |
| | G | 0.02% | 0.01% | 3.18% | 0.06% | 0.08% | 0.06% | 0.00% | 0.00% |
| | T | 0.01% | 0.01% | 0.00% | 0.00% | 0.01% | 0.01% | 0.01% | 0.00% |

| HEK2-6 pNMG-389 | | 2 | 3 | 5 | 8 | 9 | 12 | 14 | 16 |
|---|---|---|---|---|---|---|---|---|---|
| | | A | A | A | A | A | A | A | A |
| | A | 99.97% | 99.96% | 97.46% | 99.97% | 99.85% | 99.89% | 99.97% | 99.97% |
| | C | 0.00% | 0.01% | 0.00% | 0.00% | 0.02% | 0.00% | 0.00% | 0.02% |
| | G | 0.02% | 0.02% | 2.51% | 0.03% | 0.13% | 0.10% | 0.01% | 0.01% |
| | T | 0.01% | 0.02% | 0.03% | 0.00% | 0.01% | 0.01% | 0.02% | 0.00% |

FIGURE 119

HEK2-7- 3'-CCTGCAGT CAAT GAT T T GT T T T G-5'

| HEK2-7 pNMG-370 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.01% | 0.01% | 0.01% | 0.00% | 0.00% | 0.01% |
| | C | 0.02% | 0.01% | 0.04% | 0.02% | 0.01% | 0.30% | 0.01% | 0.01% | 0.01% |
| | G | 0.00% | 0.00% | 0.00% | 0.00% | 0.00% | 0.00% | 0.00% | 0.00% | 0.00% |
| | T | 99.98% | 99.99% | 99.96% | 99.98% | 99.99% | 99.69% | 99.99% | 99.99% | 99.99% |

| HEK2-7 pNMG-371 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.00% | 0.00% | 0.00% | 0.00% |
| | C | 0.02% | 0.01% | 0.07% | 0.05% | 0.05% | 0.75% | 0.04% | 0.02% | 0.01% |
| | G | 0.00% | 0.00% | 0.00% | 0.00% | 0.00% | 0.00% | 0.00% | 0.00% | 0.00% |
| | T | 99.98% | 99.98% | 99.92% | 99.95% | 99.94% | 99.24% | 99.96% | 99.98% | 99.99% |

| HEK2-7 pNMG-382 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.01% | 0.01% | 0.00% | 0.00% | 0.00% |
| | C | 0.01% | 0.01% | 0.01% | 0.01% | 0.00% | 0.26% | 0.01% | 0.01% | 0.01% |
| | G | 0.00% | 0.00% | 0.00% | 0.00% | 0.00% | 0.00% | 0.00% | 0.00% | 0.00% |
| | T | 99.99% | 99.99% | 99.99% | 99.99% | 99.99% | 99.74% | 99.99% | 99.99% | 99.98% |

| HEK2-7 pNMG-383 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.01% | 0.00% | 0.00% | 0.00% |
| | C | 0.01% | 0.01% | 0.01% | 0.02% | 0.01% | 0.23% | 0.01% | 0.01% | 0.00% |
| | G | 0.00% | 0.01% | 0.00% | 0.00% | 0.00% | 0.01% | 0.00% | 0.00% | 0.00% |
| | T | 99.99% | 99.98% | 99.99% | 99.98% | 99.99% | 99.76% | 99.98% | 99.99% | 99.99% |

| HEK2-7 pNMG-384 | | 16 T | 12 T | 9 T | 8 T | 7 T | 5 T | 4 T | 3 T | 2 T |
|---|---|---|---|---|---|---|---|---|---|---|
| | A | 0.00% | 0.01% | 0.00% | 0.00% | 0.00% | 0.01% | 0.00% | 0.00% | 0.00% |
| | C | 0.01% | 0.01% | 0.02% | 0.00% | 0.01% | 0.10% | 0.01% | 0.02% | 0.01% |
| | G | 0.00% | 0.00% | 0.00% | 0.00% | 0.00% | 0.01% | 0.00% | 0.00% | 0.00% |
| | T | 99.99% | 99.98% | 99.98% | 99.99% | 99.99% | 99.89% | 99.99% | 99.98% | 99.99% |

FIGURE 119 (Continued)

HEK2-7- 3'-CCTGCAGT CAAT GAT T T GT T T T G-5'
<sub>16</sub> <sub>12</sub> <sub>9 8 7</sub> <sub>5</sub> <sub>4 3 2</sub>

| HEK2-7 pNMG-385 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.01% | 0.00% | 0.00% | 0.00% | 0.00% | 0.00% |
| | C | 0.01% | 0.01% | 0.01% | 0.02% | 0.00% | 0.09% | 0.02% | 0.01% | 0.01% |
| | G | 0.00% | 0.01% | 0.00% | 0.00% | 0.00% | 0.01% | 0.00% | 0.00% | 0.00% |
| | T | 99.99% | 99.97% | 99.99% | 99.97% | 100.00% | 99.91% | 99.98% | 99.99% | 99.98% |

| HEK2-7 pNMG-386 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.01% | 0.00% | 0.00% | 0.00% |
| | C | 0.01% | 0.01% | 0.02% | 0.01% | 0.01% | 0.14% | 0.01% | 0.01% | 0.00% |
| | G | 0.00% | 0.00% | 0.00% | 0.00% | 0.00% | 0.00% | 0.00% | 0.00% | 0.00% |
| | T | 99.98% | 99.99% | 99.98% | 99.99% | 99.98% | 99.85% | 99.99% | 99.99% | 99.99% |

| HEK2-7 pNMG-387 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.00% | 0.01% | 0.00% | 0.01% | 0.00% | 0.00% |
| | C | 0.01% | 0.01% | 0.02% | 0.02% | 0.01% | 0.14% | 0.01% | 0.02% | 0.01% |
| | G | 0.00% | 0.01% | 0.00% | 0.00% | 0.00% | 0.01% | 0.00% | 0.00% | 0.00% |
| | T | 99.98% | 99.98% | 99.98% | 99.98% | 99.98% | 99.85% | 99.98% | 99.97% | 99.99% |

| HEK2-7 pNMG-388 | | 16 T | 12 T | 9 T | 8 T | 7 T | 5 T | 4 T | 3 T | 2 T |
|---|---|---|---|---|---|---|---|---|---|---|
| | A | 0.00% | 0.00% | 0.00% | 0.00% | 0.00% | 0.00% | 0.00% | 0.00% | 0.00% |
| | C | 0.02% | 0.02% | 0.00% | 0.02% | 0.02% | 0.38% | 0.05% | 0.00% | 0.03% |
| | G | 0.00% | 0.00% | 0.00% | 0.00% | 0.00% | 0.00% | 0.00% | 0.01% | 0.02% |
| | T | 99.98% | 99.97% | 99.99% | 99.98% | 99.98% | 99.62% | 99.95% | 99.99% | 99.95% |

| HEK2-7 pNMG-389 | | 16 T | 12 T | 9 T | 8 T | 7 T | 5 T | 4 T | 3 T | 2 T |
|---|---|---|---|---|---|---|---|---|---|---|
| | A | 0.01% | 0.00% | 0.00% | 0.00% | 0.00% | 0.00% | 0.00% | 0.00% | 0.01% |
| | C | 0.02% | 0.01% | 0.02% | 0.02% | 0.01% | 0.27% | 0.02% | 0.01% | 0.01% |
| | G | 0.00% | 0.01% | 0.00% | 0.00% | 0.01% | 0.00% | 0.00% | 0.00% | 0.00% |
| | T | 99.98% | 99.98% | 99.98% | 99.97% | 99.98% | 99.73% | 99.98% | 99.99% | 99.99% |

FIGURE 120

Hek2-10 site: 3'-CCATCAT$_{17}$T$_{16}$CT$_{14}$AT$_{12}$T$_{11}$GT$_9$T$_8$T$_7$AT$_5$GT$_3$T$_2$C-5'

| HEK2-10 pNMG-370 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.05% | 0.01% | 0.00% | 0.00% | 0.00% | 0.00% | 0.01% | 0.01% | 0.00% | 0.01% |
| | C | 0.01% | 0.01% | 0.02% | 0.19% | 0.22% | 0.19% | 0.57% | 0.94% | 6.27% | 0.53% | 0.26% |
| | G | 0.02% | 0.00% | 0.00% | 0.00% | 0.02% | 0.00% | 0.00% | 0.00% | 0.00% | 0.00% | 0.00% |
| | T | 99.97% | 99.93% | 99.96% | 99.80% | 99.76% | 99.80% | 99.43% | 99.05% | 93.72% | 99.46% | 99.74% |

| HEK2-10 pNMG-371 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.01% | 0.01% | 0.00% | 0.00% | 0.01% | 0.00% | 0.01% | 0.01% | 0.00% | 0.00% |
| | C | 0.01% | 0.01% | 0.01% | 0.09% | 0.69% | 0.73% | 2.06% | 4.06% | 15.34% | 2.52% | 0.53% |
| | G | 0.02% | 0.00% | 0.01% | 0.00% | 0.02% | 0.00% | 0.00% | 0.00% | 0.01% | 0.00% | 0.00% |
| | T | 99.97% | 99.98% | 99.98% | 99.91% | 99.30% | 99.26% | 97.94% | 95.94% | 84.64% | 97.47% | 99.46% |

| HEK2-10 pNMG-382 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.07% | 0.00% | 0.01% | 0.01% | 0.00% | 0.00% | 0.01% | 0.00% | 0.01% | 0.00% |
| | C | 0.01% | 0.01% | 0.01% | 0.23% | 0.18% | 0.03% | 0.33% | 0.23% | 3.62% | 0.29% | 0.31% |
| | G | 0.02% | 0.00% | 0.01% | 0.00% | 0.02% | 0.00% | 0.00% | 0.00% | 0.00% | 0.00% | 0.00% |
| | T | 99.97% | 99.91% | 99.98% | 99.76% | 99.79% | 99.97% | 99.66% | 99.76% | 96.38% | 99.70% | 99.69% |

| HEK2-10 pNMG-383 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.01% | 0.01% | 0.01% | 0.00% | 0.01% | 0.00% | 0.00% | 0.00% | 0.01% | 0.01% |
| | C | 0.01% | 0.01% | 0.01% | 0.05% | 0.75% | 0.08% | 0.15% | 0.20% | 3.71% | 0.19% | 0.12% |
| | G | 0.02% | 0.00% | 0.00% | 0.00% | 0.02% | 0.00% | 0.00% | 0.00% | 0.00% | 0.00% | 0.00% |
| | T | 99.97% | 99.98% | 99.98% | 99.93% | 99.23% | 99.91% | 99.85% | 99.80% | 96.28% | 99.80% | 99.87% |

| HEK2-10 pNMG-384 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.01% | 0.01% | 0.01% | 0.01% | 0.00% | 0.00% | 0.01% | 0.01% | 0.01% |
| | C | 0.01% | 0.01% | 0.01% | 0.11% | 0.83% | 0.04% | 0.13% | 0.11% | 3.14% | 0.12% | 0.14% |
| | G | 0.02% | 0.00% | 0.00% | 0.00% | 0.02% | 0.00% | 0.00% | 0.00% | 0.00% | 0.00% | 0.00% |
| | T | 99.97% | 99.97% | 99.98% | 99.88% | 99.14% | 99.96% | 99.86% | 99.89% | 96.86% | 99.87% | 99.85% |

FIGURE 120 (Continued)

Hek2-10 site: 3'-CCATCAT$_{17}$T$_{16}$CT$_{14}$AT$_{12}$T$_{11}$CT$_9$T$_8$T$_7$AT$_5$GT$_3$T$_2$C-5'

| HEK2-10 pNMG-385 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.00% | 0.00% | 0.00% | 0.01% | 0.00% | 0.00% | 0.01% | 0.01% | 0.00% |
| | C | 0.01% | 0.01% | 0.01% | 0.06% | 0.28% | 0.03% | 0.09% | 0.10% | 1.52% | 0.05% | 0.11% |
| | G | 0.02% | 0.00% | 0.00% | 0.00% | 0.02% | 0.00% | 0.00% | 0.00% | 0.00% | 0.00% | 0.00% |
| | T | 99.97% | 99.97% | 99.99% | 99.93% | 99.69% | 99.97% | 99.91% | 99.89% | 98.47% | 99.94% | 99.88% |

| HEK2-10 pNMG-386 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.07% | 0.01% | 0.00% | 0.01% | 0.01% | 0.01% | 0.00% | 0.01% | 0.01% | 0.01% |
| | C | 0.01% | 0.01% | 0.01% | 0.24% | 0.70% | 0.05% | 0.27% | 0.10% | 2.78% | 0.11% | 0.23% |
| | G | 0.01% | 0.00% | 0.01% | 0.00% | 0.01% | 0.00% | 0.00% | 0.00% | 0.00% | 0.00% | 0.00% |
| | T | 99.97% | 99.92% | 99.97% | 99.76% | 99.28% | 99.94% | 99.73% | 99.90% | 97.21% | 99.88% | 99.76% |

| HEK2-10 pNMG-387 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.01% | 0.05% | 0.00% | 0.01% | 0.00% | 0.00% | 0.00% | 0.00% | 0.01% | 0.01% | 0.00% |
| | C | 0.01% | 0.01% | 0.01% | 0.26% | 0.18% | 0.08% | 0.38% | 0.19% | 3.15% | 0.21% | 0.39% |
| | G | 0.01% | 0.00% | 0.01% | 0.00% | 0.02% | 0.00% | 0.00% | 0.01% | 0.00% | 0.00% | 0.00% |
| | T | 99.97% | 99.95% | 99.98% | 99.74% | 99.80% | 99.92% | 99.62% | 99.80% | 96.83% | 99.79% | 99.61% |

| HEK2-10 pNMG-388 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.03% | 0.00% | 0.00% | 0.00% | 0.00% | 0.00% | 0.00% | 0.01% | 0.01% | 0.01% |
| | C | 0.01% | 0.01% | 0.01% | 0.13% | 0.16% | 0.05% | 0.25% | 0.24% | 4.14% | 0.22% | 0.22% |
| | G | 0.01% | 0.00% | 0.00% | 0.00% | 0.01% | 0.00% | 0.00% | 0.00% | 0.00% | 0.00% | 0.00% |
| | T | 99.97% | 99.96% | 99.98% | 99.87% | 99.83% | 99.94% | 99.75% | 99.76% | 95.85% | 99.77% | 99.77% |

| HEK2-10 pNMG-389 | | 17 T | 16 T | 14 T | 12 T | 11 T | 9 T | 8 T | 7 T | 5 T | 3 T | 2 T |
|---|---|---|---|---|---|---|---|---|---|---|---|---|
| | A | 0.00% | 0.02% | 0.01% | 0.00% | 0.00% | 0.01% | 0.00% | 0.00% | 0.00% | 0.00% | 0.01% |
| | C | 0.01% | 0.01% | 0.01% | 0.09% | 0.23% | 0.06% | 0.18% | 0.23% | 3.10% | 0.15% | 0.21% |
| | G | 0.01% | 0.00% | 0.00% | 0.00% | 0.01% | 0.00% | 0.00% | 0.00% | 0.00% | 0.00% | 0.00% |
| | T | 99.97% | 99.97% | 99.98% | 99.91% | 99.76% | 99.93% | 99.82% | 99.77% | 96.89% | 99.84% | 99.78% |

FIGURE 121

Hek3- 5'-GGCCCA GA CTGA GCA CGTGATGG-3'
            6    8    12   15

| HEK3 pNMG-370 | 6 A | 8 A | 12 A | 15 A |
|---|---|---|---|---|
| A | 98.94% | 97.53% | 99.94% | 99.97% |
| C | 0.01% | 0.01% | 0.01% | 0.02% |
| G | 1.04% | 2.46% | 0.04% | 0.01% |
| T | 0.00% | 0.01% | 0.00% | 0.00% |

| HEK3 pNMG-371 | 6 A | 8 A | 12 A | 15 A |
|---|---|---|---|---|
| A | 98.05% | 95.74% | 99.97% | 99.99% |
| C | 0.00% | 0.00% | 0.00% | 0.00% |
| G | 1.95% | 4.25% | 0.03% | 0.01% |
| T | 0.00% | 0.00% | 0.00% | 0.00% |

| HEK3 pNMG-382 | 6 A | 8 A | 12 A | 15 A |
|---|---|---|---|---|
| A | 99.39% | 97.01% | 99.93% | 99.99% |
| C | 0.01% | 0.01% | 0.01% | 0.01% |
| G | 0.60% | 2.98% | 0.05% | 0.00% |
| T | 0.00% | 0.00% | 0.00% | 0.00% |

| HEK3 pNMG-383 | 6 A | 8 A | 12 A | 15 A |
|---|---|---|---|---|
| A | 99.49% | 97.31% | 99.95% | 99.99% |
| C | 0.00% | 0.00% | 0.00% | 0.00% |
| G | 0.50% | 2.68% | 0.04% | 0.01% |
| T | 0.01% | 0.00% | 0.00% | 0.00% |

| HEK3 pNMG-384 | 6 A | 8 A | 12 A | 15 A |
|---|---|---|---|---|
| A | 99.70% | 98.15% | 99.96% | 99.98% |
| C | 0.01% | 0.01% | 0.01% | 0.01% |
| G | 0.28% | 1.83% | 0.03% | 0.01% |
| T | 0.01% | 0.01% | 0.00% | 0.00% |

| HEK3 pNMG-385 | 6 A | 8 A | 12 A | 15 A |
|---|---|---|---|---|
| A | 99.75% | 98.93% | 99.98% | 99.99% |
| C | 0.00% | 0.00% | 0.00% | 0.00% |
| G | 0.25% | 1.06% | 0.02% | 0.01% |
| T | 0.01% | 0.01% | 0.00% | 0.00% |

| HEK3 pNMG-385 | 6 A | 8 A | 12 A | 15 A |
|---|---|---|---|---|
| A | 99.75% | 98.93% | 99.98% | 99.99% |
| C | 0.00% | 0.00% | 0.00% | 0.00% |
| G | 0.25% | 1.06% | 0.02% | 0.01% |
| T | 0.01% | 0.01% | 0.00% | 0.00% |

| HEK3 pNMG-386 | 6 A | 8 A | 12 A | 15 A |
|---|---|---|---|---|
| A | 99.55% | 97.94% | 99.94% | 99.96% |
| C | 0.03% | 0.02% | 0.03% | 0.03% |
| G | 0.41% | 2.04% | 0.03% | 0.01% |
| T | 0.00% | 0.00% | 0.00% | 0.01% |

| HEK3 pNMG-387 | 6 A | 8 A | 12 A | 15 A |
|---|---|---|---|---|
| A | 99.64% | 97.14% | 99.95% | 99.98% |
| C | 0.00% | 0.00% | 0.01% | 0.00% |
| G | 0.36% | 2.86% | 0.04% | 0.01% |
| T | 0.00% | 0.01% | 0.00% | 0.01% |

| HEK3 pNMG-388 | 6 A | 8 A | 12 A | 15 A |
|---|---|---|---|---|
| A | 99.39% | 97.54% | 99.94% | 99.98% |
| C | 0.00% | 0.00% | 0.00% | 0.00% |
| G | 0.59% | 2.45% | 0.05% | 0.01% |
| T | 0.01% | 0.01% | 0.00% | 0.01% |

| HEK3 pNMG-389 | 6 A | 8 A | 12 A | 15 A |
|---|---|---|---|---|
| A | 99.53% | 97.35% | 99.96% | 99.98% |
| C | 0.01% | 0.00% | 0.00% | 0.00% |
| G | 0.46% | 2.63% | 0.03% | 0.01% |
| T | 0.01% | 0.01% | 0.00% | 0.01% |

| Site | Protospacer and PAM sequence | pNMG370 | pNMG371 | pNMG382-389 | | | | | | | |
|---|---|---|---|---|---|---|---|---|---|---|---|
| HEK2 | GAACACAAAGCATAGACTGCTGG | 54.0 | 65.4 | 48.4 | 52.9 | 44.6 | 40.3 | 41.0 | 44.8 | 43.6 | 40.6 |
| HEK2-2 | GAATACTAAGCATAGACTCCAGG | 29.1 | 50.1 | 24.5 | 23.8 | 21.8 | 11.3 | 20.5 | 21.6 | 23.8 | 23.4 |
| HEK2-3 | GTAAACAAAGCATAGACTGAGGG | 10.4 | 20.1 | 8.2 | 11.0 | 4.7 | 3.5 | 8.0 | 4.2 | 8.5 | 6.2 |
| HEK2-6 | GAAGACCAAGGATAGACTGCTGG | 4.4 | 7.6 | 4.6 | 5.5 | 2.8 | 1.4 | 2.4 | 2.5 | 3.2 | 2.5 |
| HEK2-7 | GAAAACAAATCATTGACTGCAGG | 0.3 | 0.7 | 0.3 | 0.2 | 0.1 | 0.1 | 0.1 | 0.1 | 0.4 | 0.3 |
| HEK2-10 | GAACATAAAGAATAGAATGATGG | 6.3 | 21.4 | 3.6 | 6.3 | 4.6 | 2.0 | 4.2 | 4.1 | 5.5 | 4.0 |

| | position: | 11 | 35 | 36 | 37 | 47 | 48 | 49 | 51 | 69 | 70 | 72 | 77 | 84 | 88 | 106 | 107 | 108 | 111 | 123 | 134 | 137 | 146 | 147 | 154 | 155 | 156 | 157 | 158 | 160 | 161 |
|---|---|---|---|---|---|---|---|---|---|---|---|---|---|---|---|---|---|---|---|---|---|---|---|---|---|---|---|---|---|---|---|
| | wt res: | Trp | Val | His | Asn | Arg | Pro | Ile | Arg | Val | Met | Asn | Asp | Leu | Val | Ala | Arg | Asp | Thr | His | Glu | Leu | Ser | Asp | Gln | Glu | Ile | Lys | Ala | Lys | Lys |
| 1 | | | | | | | | | Leu | | | | | Phe | | Val | | Asn | | Tyr | | | | Tyr | | Val | Phe | | | | |
| 2 | | | | | Ser | | | | His | | | | Gly | Phe | | Val | | Asn | | Tyr | | | | Tyr | | Val | Phe | | | | |
| 3 | | | | | | | | | | | Thr | | | Phe | | Val | | Asn | | Tyr | | | | Tyr | His | Val | Phe | | | | |
| 4 | | | | Leu | | | Leu | | | | | | | Phe | | Val | | Asn | | Tyr | Gly | | | Tyr | | Val | Phe | | Ser | | |
| 5 | | | | | Ser | | | | | | | | | Phe | | Val | | Asn | | Tyr | | | | Tyr | | Val | Phe | | | | |
| 6 | | | | | | | | | | | | Ser | | Phe | | Ala | | Asn | | Tyr | | | | Tyr | | Val | Phe | | | | |
| 7 | | | | | Thr | | Thr | Val | | | Leu | | | Phe | | Val | | Asn | | Tyr | | | | Tyr | | Val | Phe | | | | |
| 8 | | | | | | | | | | Ala | | | | Phe | | Val | | Asn | | Tyr | | | | Tyr | | Val | Phe | | | | |
| 9 | | | | Leu | | | | | | | | | | Phe | | Val | | Asn | | Tyr | | | | Tyr | | Val | Phe | | | Ile | |
| 10 | | | Glu | | | | | | | | | | | Phe | | Val | | Asn | | Tyr | | | | Tyr | | Val | Phe | | | | |
| 11 | | | | | | | | | | | | | | Phe | | Val | | Asn | | Tyr | | | | Tyr | | Val | Phe | | | | |
| 12 | | | | | | | | | | | | | | Phe | | Val | | Asn | | Tyr | | | | Tyr | | Val | Phe | Asn | | | |
| 13 | | | | | | | | | | | | | | Phe | | Val | | Asn | | Tyr | | | | Tyr | | Val | Phe | | | | Thr |
| 14 | | | | | | | | | | | | | | Phe | | Val | | Asn | | Tyr | Gly | | | Cys | | Val | Phe | | Ser | | |
| 15 | | | | Leu | | | Leu | | | | | | | Phe | | Val | | Asn | | Tyr | | | Cys | Tyr | | Val | Phe | | | | |
| 16 | | | | | | | | | | | | | | Phe | | Val | | Asn | | Tyr | | | | Tyr | | Ala | Phe | | | | |
| 17 | | | | | | | | | | | | | Gly | Phe | | Val | | Asn | | Tyr | | | Arg | Tyr | | Val | Phe | | | Ile | |
| 18 | | | | | Ser | Ser | | | | | | | | Phe | | Val | Cys | Asn | | Tyr | | | | Tyr | | Val | Phe | | | | Thr |
| 19 | | Arg | | | | | | | | Ala | | | | Phe | | Val | | Asn | | Tyr | | | | Tyr | | Val | Phe | | | | |
| 20 | | | | | Ser | | | | His | | | Ser | | Phe | | Val | | Asn | | Tyr | | | | Tyr | | Ala | Phe | | | | |
| 21 | | | | Leu | | | Leu | | | | | | | Phe | | Val | | Asn | | Tyr | Gly | | | Tyr | His | Val | Phe | | | | |
| 22 | | | | | | | | | | | | | | Phe | | Val | | Asn | | Tyr | | | Cys | Tyr | | Val | Phe | | | | |
| 23 | | | | | | | | | Leu | | | | | Phe | | Val | | Asn | | Tyr | | | | Tyr | | Val | Phe | Asn | | | |
| 24 | | | | Leu | | | | | | | | | | Phe | | Val | | Asn | | Tyr | | | | Tyr | | Val | Phe | Asn | | | |
| 25 | | | | Leu | | | Leu | | | | | | | Phe | | Val | | Asn | | Tyr | Gly | | | Tyr | | Val | Phe | | | | |
| 26 | | | | | Thr | | Thr | Val | | | Leu | | | Phe | | Val | | Asn | | Tyr | | | Arg | Tyr | | Val | Phe | | | | |
| 27 | | | | | | | | | | | | | | Phe | | Val | | Asn | | Tyr | | | | Tyr | | Val | Phe | | | | | evolution #1
evolution #2
evolution #3

FIGURE 126A 384 ug/mL spectinomycin (5h):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asn | His | Glu | Ser | Asp | Gln | Glu | Ile | Lys | Ala | Lys | Lys | Gln |
| 1 | | | | Thr | Val | | | | | | Phe | Val | Asn | Tyr | | | | | Val | Phe | Asn | | | | |
| 2 | Leu | | | Thr | | | | | | | Phe | Val | Asn | Tyr | | | | | Val | Phe | Asn | | | | |
| 3 | | | | | | | | | | | Phe | Val | Asn | Tyr | | | | | Val | Phe | Asn | | | | |
| 4 | | | | | | | | Leu | | | Phe | Val | Asn | Tyr | | | | | Val | Phe | | | | | |
| 5 | | Ser | | | | | | | | Gly | Phe | Val | Asn | Tyr | | | | | Val | Phe | | | | | |
| 6 | | | | | | Leu | | | | | Phe | Val | Asn | Tyr | | Cys | | | Val | Phe | | | | Thr | |
| 7 | Leu | | | | | His | | | | | Phe | Val | Asn | Tyr | | | | | Val | Phe | | | | | |
| 8 | | | | | | | | | | | Phe | Val | Asn | Tyr | | Arg | | | Val | Phe | | | | Thr | |
| 9 | | | | | | | | | | | Phe | Val | Asn | Tyr | | | | | Val | Phe | | | | | | evolution #1
evolution #2
evolution #3

FIGURE 126B 384 ug/mL spectinomycin (7h):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asn | His | Glu | Ser | Asp | Gln | Glu | Ile | Lys | Ala | Lys | Lys | Gln |
| 1 | Ser | | | | | Leu | | | | | Phe | Val | Asn | Tyr | | | Tyr | | Val | Phe | | | | | |
| 2 | | | | | | Leu | | | Ser | | Phe | Val | Asn | Tyr | | | Tyr | | Val | Phe | | | Ile | | |
| 4 | Ser | | | | | His | | | | | Phe | Val | Asn | Tyr | | | Tyr | | Val | Phe | | | | | |
| 5 | | | | | | Leu | | | | | Phe | Val | Asn | Tyr | | | Tyr | | Val | Phe | | | | | |
| 6 | Ser | | | | | His | | | | Gly | Phe | Val | Asn | Tyr | | Cys | Tyr | | Val | Phe | Asn | | | | |
| 7 | | | | | | | | | | | Phe | Val | Asn | Tyr | | | Tyr | | Val | Phe | | | | | |
| 8 | | | | | | | | | | | Phe | Val | Asn | Tyr | | | Tyr | | Val | Phe | | | | | | evolution #1
evolution #2
evolution #3

FIGURE 126C 128 ug/mL chloramphenicol (7h):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | | | | | | | | | | | | | | | | | | | | | | | | |
| 2 | | | | | | Leu | | | | | Phe | Val | Asn | Tyr | | | | | | Phe | | | | | |
| 3 | | Thr | | Thr | Val | | | Leu | | | Phe | Val | Asn | Tyr | | Arg | | | | Phe | | | | | |
| 4 | | | | Thr | Val | | | Leu | | | Phe | Val | Asn | Tyr | | Cys | | | | Phe | | | | | |
| 5 | | | | | | Leu | | | | | Phe | Val | Asn | Tyr | | Arg | | | | Phe | | | | | |
| 2 | | | | | | | | | | Gly | Phe | Val | Asn | Tyr | | | | His | | Phe | | | | Thr | |
| 3 | | | | | | | | | | | Phe | Val | Asn | Tyr | | | | | | Phe | | | | | |

- evolution #1
- evolution #2
- evolution #3

FIGURE 126D 128 ug/mL chloramphenicol + 128 ug/mL spectinomycin (overnight):

| position: | 36 | 37 | 47 | 48 | 49 | 51 | 69 | 70 | 72 | 77 | 84 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | | | | | | | Thr | | | Phe | Val | Asn | Tyr | | | | | | Phe | | | | | |
| 2 | | | | | | | | | | | Phe | Val | Asn | Tyr | | | | | | Phe | | | | | |

- evolution #1
- evolution #2
- evolution #3

FIGURE 126E 128 ug/mL chloramphenicol + 256 ug/mL spectinomycin (overnight)

| position: | 36 | 37 | 47 | 48 | 49 | 51 | 69 | 70 | 72 | 77 | 83 | 106 | 108 | 123 | 134 | 146 | 147 | 154 | 155 | 156 | 157 | 159 | 160 | 161 | 163 |
|---|---|---|---|---|---|---|---|---|---|---|---|---|---|---|---|---|---|---|---|---|---|---|---|---|---|
| wt res: | His | Asn | Arg | Pro | Ile | Arg | Val | Met | Asn | Asp | Leu | Ala | Asp | His | Glu | Ser | Asp | Gln | Glu | Ile | Lys | Ala | Lys | Lys | Gln |
| 1 | | | | | | | | | | | Phe | Val | Asn | Tyr | | | Asp | | Val | Phe | | | | Thr | |
| 2 | | | | Ser | | | | | Ser | | Phe | Val | Asn | Tyr | Gly | | Asp | | Val | Phe | | | | | |
| 3 | | | | | | | | | | | Phe | Val | Asn | Tyr | | Cys | Asp | | Val | Phe | | | | | |
| 4 | | | | | | | | | | | Phe | Val | Asn | Tyr | | | Asp | | Val | Phe | | | | | | evolution #1
evolution #2
evolution #3

FIGURE 127

| position: | 36 | 37 | 47 | 48 | 49 | 51 | 61 | 69 | 70 | 72 | 76 | 77 | 78 | 84 | 91 | 96 | 104 | 106 | 108 | 123 | 125 | 134 | 146 | 147 | 154 | 155 | 156 | 157 | 159 | 160 | 161 | 162 | 163 |
|---|---|---|---|---|---|---|---|---|---|---|---|---|---|---|---|---|---|---|---|---|---|---|---|---|---|---|---|---|---|---|---|---|---|
| wt res: | His | Asn | Arg | Pro | Ile | Arg | Met | Val | Met | Asn | Ile | Asp | Ala | Leu | Ala | Ser | Phe | Ala | Asp | His | Gly | Glu | Ser | Asp | Gln | Glu | Ile | Lys | Ala | Lys | Lys | Ala | Gln |
| 1 | | | | | | | | | | | Thr | | | Phe | | | | Val | Asn | Tyr | | | | | | Glu | Phe | | | | | | |
| 2 | | | | | | | | | | | | His | Thr | Phe | | | | Val | Asn | Tyr | | | | | | Glu | Phe | | | | | | |
| 3 | | | | | | | | | | Asp | | | | Phe | | | | Val | Asn | Tyr | Ala | | | Asp | | Glu | Phe | | | | | | |
| 4 | | | | Ser | | | | | | | | | | Phe | | | | Val | Asn | Tyr | | | | Asp | | Glu | Phe | | | | | | |
| 5 | | | | Leu | | | | | | | | | | Phe | Thr | | | Val | Asn | Tyr | | | | Asp | | Glu | Phe | | | | | | |
| 6 | | | | | | | | | | | | | | Phe | | Cys | | Val | Asn | Tyr | | | | Asp | | Glu | Phe | | | | | | |
| 7 | | | | | | | | | | | | | | Phe | | | Ile | Val | Asn | Tyr | | Val | | Asp | | Glu | Phe | | | | | Val | | evolution #1
evolution #2
evolution #3

Hek-2 site: 5'-GA$_2$A$_3$CA$_5$CA$_7$A$_8$A$_9$GCA$_{12}$TA$_{14}$GA$_{16}$CTGCGGG-3'

| HEK2 pNMG-339 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.8% | 95.9% | — | 98.4% | 98.5% | 99.3% | 99.9% | 100.0% | 100.0% |
| | C | 0.0% | 0.0% | 0.0% | 0.0% | 0.0% | 0.0% | 0.0% | 0.0% | 0.0% |
| | G | 0.2% | 4.1% | — | 1.6% | 1.5% | 0.7% | 0.0% | 0.0% | 0.0% |
| | T | 0.0% | 0.0% | 0.0% | 0.0% | 0.0% | 0.0% | 0.0% | 0.0% | 0.0% |

| HEK2 pNMG-340 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.89% | 97.88% | — | 99.43% | 98.98% | 99.54% | 99.98% | 99.99% | 99.99% |
| | C | 0.00% | 0.00% | 0.00% | 0.00% | 0.00% | 0.00% | 0.00% | 0.00% | 0.00% |
| | G | 0.10% | 2.12% | — | 0.56% | 1.02% | 0.45% | 0.01% | 0.01% | 0.01% |
| | T | 0.00% | 0.00% | 0.01% | 0.00% | 0.01% | 0.00% | 0.00% | 0.00% | 0.00% |

| HEK2 pNMG-341 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.80% | 94.79% | — | 98.16% | 98.08% | 99.02% | 99.92% | 99.98% | 99.99% |
| | C | 0.00% | 0.01% | 0.00% | 0.00% | 0.00% | 0.00% | 0.00% | 0.00% | 0.00% |
| | G | 0.19% | 5.19% | — | 1.84% | 1.91% | 0.98% | 0.07% | 0.02% | 0.01% |
| | T | 0.00% | 0.01% | 0.01% | 0.00% | 0.00% | 0.00% | 0.00% | 0.01% | 0.00% |

| HEK2 pNMG-346 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.89% | 93.08% | 99.91% | 99.98% | 99.89% | 99.99% | 99.98% | 99.99% |
| | C | 0.00% | 0.01% | 0.00% | 0.00% | 0.00% | 0.00% | 0.00% | 0.00% | 0.00% |
| | G | 0.02% | 0.10% | 6.91% | 0.04% | 0.01% | 0.10% | 0.01% | 0.01% | 0.01% |
| | T | 0.00% | 0.00% | 0.01% | 0.02% | 0.01% | 0.00% | 0.01% | 0.00% | 0.00% |

| HEK2 pNMG-347 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.68% | 87.50% | 99.89% | 99.86% | 99.74% | 99.99% | 99.99% | 99.99% |
| | C | 0.00% | 0.01% | 0.00% | 0.00% | 0.00% | 0.00% | 0.00% | 0.00% | 0.00% |
| | G | 0.03% | 0.31% | 12.49% | 0.11% | 0.13% | 0.26% | 0.01% | 0.01% | 0.01% |
| | T | 0.01% | 0.00% | 0.01% | 0.00% | 0.00% | 0.00% | 0.01% | 0.00% | 0.00% |

| HEK2 pNMG-348 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.98% | 99.72% | 84.65% | 99.93% | 99.93% | 99.80% | 99.92% | 99.96% | 99.99% |
| | C | 0.00% | 0.00% | 0.00% | 0.00% | 0.00% | 0.00% | 0.00% | 0.00% | 0.00% |
| | G | 0.01% | 0.27% | 15.34% | 0.06% | 0.06% | 0.10% | 0.07% | 0.02% | 0.01% |
| | T | 0.00% | 0.01% | 0.01% | 0.00% | 0.00% | 0.00% | 0.00% | 0.01% | 0.00% |

| HEK2 pNMG-349 | | 2 | 3 | 5 | 7 | 8 | 9 | 12 | 14 | 16 |
|---|---|---|---|---|---|---|---|---|---|---|
| | | A | A | A | A | A | A | A | A | A |
| | A | 99.98% | 99.71% | 85.59% | 99.94% | 99.84% | 99.92% | 99.97% | 99.97% | 99.99% |
| | C | 0.00% | 0.00% | 0.00% | 0.00% | 0.00% | 0.00% | 0.00% | 0.00% | 0.00% |
| | G | 0.02% | 0.28% | 14.40% | 0.05% | 0.15% | 0.07% | 0.02% | 0.02% | 0.01% |
| | T | 0.00% | 0.00% | 0.01% | 0.00% | 0.01% | 0.00% | 0.01% | 0.01% | 0.00% |

FIGURE 130

Hek 2-1 site: 5'-GA$_2$A$_3$A$_4$A$_5$A$_6$A$_7$A$_8$A$_9$GCA$_{12}$GA$_{14}$GACTGCTGG-3'

| HEK2-1 pNMG-339 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.99% | 99.99% | 99.97% | 99.89% | 99.97% | 99.98% | 99.98% | 99.97% | 99.97% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.03% | 0.10% | 0.03% | 0.01% | 0.01% | 0.02% | 0.02% | 0.01% |
| | T | 0.00% | 0.00% | 0.00% | 0.00% | 0.00% | 0.00% | 0.01% | 0.00% | 0.01% | 0.01% |

| HEK2-1 pNMG-340 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.99% | 99.99% | 99.98% | 99.88% | 99.98% | 99.98% | 99.98% | 99.97% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.01% | 0.11% | 0.02% | 0.01% | 0.01% | 0.03% | 0.01% | 0.01% |
| | T | 0.00% | 0.00% | 0.00% | 0.00% | 0.00% | 0.00% | 0.01% | 0.00% | 0.01% | 0.01% |

| HEK2-1 pNMG-341 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.98% | 99.99% | 99.94% | 99.76% | 99.93% | 99.98% | 99.98% | 99.98% | 99.98% | 99.99% |
| | C | 0.00% | 0.00% | 0.00% | 0.00% | 0.00% | 0.00% | 0.00% | 0.00% | 0.00% | 0.00% |
| | G | 0.01% | 0.01% | 0.05% | 0.23% | 0.07% | 0.01% | 0.01% | 0.02% | 0.01% | 0.01% |
| | T | 0.01% | 0.00% | 0.00% | 0.00% | 0.00% | 0.00% | 0.00% | 0.00% | 0.01% | 0.01% |

| HEK2-1 pNMG-346 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.99% | 99.99% | 99.99% | 99.99% | 99.99% | 99.99% | 99.98% | 99.97% | 99.98% | 99.98% |
| | C | 0.00% | 0.00% | 0.00% | 0.00% | 0.00% | 0.00% | 0.00% | 0.00% | 0.00% | 0.00% |
| | G | 0.01% | 0.01% | 0.00% | 0.01% | 0.01% | 0.01% | 0.01% | 0.02% | 0.01% | 0.01% |
| | T | 0.00% | 0.00% | 0.00% | 0.00% | 0.00% | 0.00% | 0.01% | 0.00% | 0.01% | 0.01% |

| HEK2-1 pNMG-347 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.99% | 99.99% | 99.99% | 99.98% | 99.99% | 99.99% | 99.99% | 99.98% | 99.97% | 99.99% |
| | C | 0.00% | 0.00% | 0.00% | 0.00% | 0.00% | 0.00% | 0.00% | 0.00% | 0.00% | 0.00% |
| | G | 0.01% | 0.00% | 0.01% | 0.02% | 0.01% | 0.00% | 0.01% | 0.02% | 0.02% | 0.01% |
| | T | 0.00% | 0.00% | 0.00% | 0.00% | 0.00% | 0.00% | 0.00% | 0.00% | 0.01% | 0.01% |

| HEK2-1 pNMG-348 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.99% | 99.99% | 99.99% | 99.99% | 99.99% | 99.99% | 99.99% | 99.98% | 99.98% | 99.99% |
| | C | 0.00% | 0.00% | 0.00% | 0.00% | 0.00% | 0.00% | 0.00% | 0.00% | 0.00% | 0.00% |
| | G | 0.00% | 0.01% | 0.01% | 0.01% | 0.00% | 0.01% | 0.01% | 0.02% | 0.01% | 0.01% |
| | T | 0.00% | 0.00% | 0.00% | 0.00% | 0.00% | 0.00% | 0.00% | 0.00% | 0.01% | 0.01% |

| HEK2-1 pNMG-349 | | 2 | 3 | 4 | 5 | 6 | 7 | 8 | 9 | 12 | 14 |
|---|---|---|---|---|---|---|---|---|---|---|---|
| | | A | A | A | A | A | A | A | A | A | A |
| | A | 99.99% | 99.99% | 100.00% | 99.98% | 99.98% | 99.99% | 99.99% | 99.98% | 99.97% | 99.99% |
| | C | 0.00% | 0.00% | 0.00% | 0.00% | 0.00% | 0.00% | 0.00% | 0.00% | 0.00% | 0.00% |
| | G | 0.00% | 0.01% | 0.00% | 0.01% | 0.01% | 0.01% | 0.01% | 0.02% | 0.02% | 0.01% |
| | T | 0.00% | 0.00% | 0.00% | 0.00% | 0.00% | 0.00% | 0.00% | 0.00% | 0.01% | 0.01% |

FIGURE 131

Hek 2-2 site: 5'-GA₂A₃TA₅CTA₈A₉GCA₁₂TA₁₄GA₁₆CTCCAGG-3'

| HEK2-2 pNMG-339 | | 2 | 3 | 5 | 8 | 9 | 12 | 14 | 16 |
|---|---|---|---|---|---|---|---|---|---|
| | | A | A | A | A | A | A | A | A |
| | A | 99.63% | 99.44% | | 99.54% | 99.65% | 99.97% | 99.97% | 99.97% |
| | C | 0.00% | 0.00% | 0.00% | 0.00% | 0.00% | 0.00% | 0.00% | 0.00% |
| | G | 0.36% | 0.55% | | 0.45% | 0.35% | 0.01% | 0.01% | 0.01% |
| | T | 0.01% | 0.00% | 0.01% | 0.01% | 0.00% | 0.01% | 0.01% | 0.01% |

| HEK2-2 pNMG-340 | | 2 | 3 | 5 | 8 | 9 | 12 | 14 | 16 |
|---|---|---|---|---|---|---|---|---|---|
| | | A | A | A | A | A | A | A | A |
| | A | 99.84% | 99.83% | | 99.58% | 99.91% | 99.98% | 99.97% | 99.97% |
| | C | 0.00% | 0.00% | 0.00% | 0.00% | 0.00% | 0.00% | 0.00% | 0.00% |
| | G | 0.15% | 0.16% | | 0.40% | 0.09% | 0.01% | 0.01% | 0.01% |
| | T | 0.00% | 0.01% | 0.02% | 0.00% | 0.00% | 0.01% | 0.01% | 0.01% |

| HEK2-2 pNMG-341 | | 2 | 3 | 5 | 8 | 9 | 12 | 14 | 16 |
|---|---|---|---|---|---|---|---|---|---|
| | | A | A | A | A | A | A | A | A |
| | A | 99.56% | 99.28% | | 99.35% | 99.60% | 99.95% | 99.97% | 99.97% |
| | C | 0.00% | 0.00% | 0.00% | 0.00% | 0.00% | 0.00% | 0.00% | 0.00% |
| | G | 0.42% | 0.70% | | 0.64% | 0.40% | 0.03% | 0.01% | 0.01% |
| | T | 0.01% | 0.00% | 0.01% | 0.01% | 0.00% | 0.02% | 0.01% | 0.01% |

| HEK2-2 pNMG-346 | | 2 | 3 | 5 | 8 | 9 | 12 | 14 | 16 |
|---|---|---|---|---|---|---|---|---|---|
| | | A | A | A | A | A | A | A | A |
| | A | 99.98% | 99.96% | | 99.91% | 99.98% | 99.98% | 99.97% | 99.97% |
| | C | 0.00% | 0.00% | 0.00% | 0.00% | 0.00% | 0.00% | 0.00% | 0.00% |
| | G | 0.00% | 0.02% | 9.40% | 0.05% | 0.02% | 0.01% | 0.01% | 0.01% |
| | T | 0.01% | 0.00% | 0.02% | 0.01% | 0.01% | 0.01% | 0.01% | 0.01% |

| HEK2-2 pNMG-347 | | 2 | 3 | 5 | 8 | 9 | 12 | 14 | 16 |
|---|---|---|---|---|---|---|---|---|---|
| | | A | A | A | A | A | A | A | A |
| | A | 99.99% | 99.96% | | 99.93% | 99.97% | 99.97% | 99.97% | 99.97% |
| | C | 0.00% | 0.00% | 0.00% | 0.00% | 0.00% | 0.00% | 0.00% | 0.00% |
| | G | 0.01% | 0.03% | | 0.06% | 0.03% | 0.01% | 0.01% | 0.01% |
| | T | 0.01% | 0.00% | 0.01% | 0.00% | 0.00% | 0.02% | 0.01% | 0.01% |

| HEK2-2 pNMG-348 | | 2 | 3 | 5 | 8 | 9 | 12 | 14 | 16 |
|---|---|---|---|---|---|---|---|---|---|
| | | A | A | A | A | A | A | A | A |
| | A | 99.98% | 99.95% | | 99.91% | 99.98% | 99.97% | 99.97% | 99.97% |
| | C | 0.00% | 0.00% | 0.00% | 0.00% | 0.00% | 0.00% | 0.00% | 0.00% |
| | G | 0.01% | 0.07% | | 0.08% | 0.02% | 0.01% | 0.01% | 0.01% |
| | T | 0.01% | 0.00% | 0.02% | 0.01% | 0.00% | 0.02% | 0.01% | 0.01% |

| HEK2-2 pNMG-349 | | 2 | 3 | 5 | 8 | 9 | 12 | 14 | 16 |
|---|---|---|---|---|---|---|---|---|---|
| | | A | A | A | A | A | A | A | A |
| | A | 99.98% | 99.95% | | 99.92% | 99.99% | 99.97% | 99.97% | 99.97% |
| | C | 0.00% | 0.00% | 0.00% | 0.00% | 0.00% | 0.00% | 0.00% | 0.00% |
| | G | 0.01% | 0.05% | | 0.07% | 0.01% | 0.01% | 0.01% | 0.01% |
| | T | 0.01% | 0.01% | 0.01% | 0.01% | 0.00% | 0.02% | 0.01% | 0.01% |

FIGURE 132

Hek 2-3 site: 5'-GTA₃A₄A₅CA₇A₈A₉GCA₁₂TA₁₄GA₁₆CTGAGGG-3'

| HEK2-3 pNMG-339 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.98% | 99.98% | 99.43% | 99.98% | 99.97% | 99.98% | 99.97% | 99.97% | 99.97% |
| | C | 0.00% | 0.00% | 0.00% | 0.00% | 0.00% | 0.00% | 0.00% | 0.00% | 0.00% |
| | G | 0.01% | 0.02% | 0.56% | 0.01% | 0.01% | 0.01% | 0.01% | 0.01% | 0.01% |
| | T | 0.01% | 0.00% | 0.01% | 0.00% | 0.01% | 0.01% | 0.01% | 0.01% | 0.01% |

| HEK2-3 pNMG-340 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.96% | 99.02% | 99.96% | 99.97% | 99.76% | 99.96% | 99.97% | 99.97% |
| | C | 0.00% | 0.00% | 0.00% | 0.00% | 0.00% | 0.19% | 0.00% | 0.00% | 0.00% |
| | G | 0.03% | 0.03% | 0.97% | 0.03% | 0.03% | 0.05% | 0.02% | 0.01% | 0.01% |
| | T | 0.01% | 0.01% | 0.01% | 0.01% | 0.00% | 0.00% | 0.02% | 0.01% | 0.01% |

| HEK2-3 pNMG-341 | | 3 | 4 | 5 | 7 | 8 | 9 | 12 | 14 | 16 |
|---|---|---|---|---|---|---|---|---|---|---|
| | | A | A | A | A | A | A | A | A | A |
| | A | 99.97% | 99.95% | 98.58% | 99.97% | 99.97% | 99.79% | 99.96% | 99.97% | 99.97% |
| | C | 0.00% | 0.00% | 0.00% | 0.00% | 0.00% | 0.19% | 0.00% | 0.00% | 0.00% |
| | G | 0.02% | 0.05% | 1.42% | 0.01% | 0.02% | 0.02% | 0.02% | 0.01% | 0.01% |
| | T | 0.01% | 0.01% | 0.01% | 0.01% | 0.01% | 0.00% | 0.02% | 0.01% | 0.01% |

FIGURE 133

Hek 2-4 site: 5'-GGA$_3$CA$_5$CA$_7$A$_8$A$_9$GCTTA$_{14}$GA$_{16}$CTCCAGG-3'

| HEK2-4 pNMG-339 | | 3 | 5 | 7 | 8 | 9 | 14 | 16 |
|---|---|---|---|---|---|---|---|---|
| | | A | A | A | A | A | A | A |
| | A | 95.12% | | 99.50% | 99.35% | 99.67% | 99.98% | 99.98% |
| | C | 0.00% | 0.01% | 0.00% | 0.00% | 0.00% | 0.00% | 0.00% |
| | G | 4.87% | | 0.49% | 0.64% | 0.32% | 0.01% | 0.01% |
| | T | 0.01% | 0.01% | 0.01% | 0.01% | 0.00% | 0.00% | 0.00% |

| HEK2-4 pNMG-340 | | 3 | 5 | 7 | 8 | 9 | 14 | 16 |
|---|---|---|---|---|---|---|---|---|
| | | A | A | A | A | A | A | A |
| | A | 97.41% | | 99.76% | 99.67% | 99.82% | 99.98% | 99.98% |
| | C | 0.00% | 0.00% | 0.00% | 0.00% | 0.00% | 0.00% | 0.00% |
| | G | 2.58% | | 0.23% | 0.32% | 0.17% | 0.02% | 0.01% |
| | T | 0.01% | 0.01% | 0.01% | 0.00% | 0.00% | 0.00% | 0.00% |

| HEK2-4 pNMG-341 | | 3 | 5 | 7 | 8 | 9 | 14 | 16 |
|---|---|---|---|---|---|---|---|---|
| | | A | A | A | A | A | A | A |
| | A | 93.73% | | 99.34% | 99.22% | 99.69% | 99.98% | 99.98% |
| | C | 0.00% | 0.02% | 0.00% | 0.00% | 0.00% | 0.00% | 0.00% |
| | G | 6.26% | | 0.65% | 0.78% | 0.30% | 0.02% | 0.01% |
| | T | 0.01% | 0.01% | 0.01% | 0.00% | 0.00% | 0.00% | 0.00% |

FIGURE 134

Hek2-6 similar: 5'-GA$_2$A$_3$GA$_5$CCA$_8$A$_9$GGATAGACTGCTGG-3'

| HEK2-6 pNMG-339 | 2 A | 3 A | 5 A | 8 A | 9 A | 12 A | 14 A |
|---|---|---|---|---|---|---|---|
| A | 99.94% | 99.86% | 95.56% | 99.74% | 99.90% | 99.97% | 99.98% |
| C | 0.00% | 0.01% | 0.00% | 0.00% | 0.00% | 0.00% | 0.00% |
| G | 0.04% | 0.12% | 4.43% | 0.24% | 0.08% | 0.01% | 0.01% |
| T | 0.01% | 0.01% | 0.01% | 0.02% | 0.01% | 0.02% | 0.00% |

| HEK2-6 pNMG-340 | 2 A | 3 A | 5 A | 8 A | 9 A | 12 A | 14 A |
|---|---|---|---|---|---|---|---|
| A | 99.97% | 99.97% | 95.74% | 99.81% | 99.90% | 99.98% | 99.98% |
| C | 0.00% | 0.00% | 0.00% | 0.01% | 0.00% | 0.00% | 0.00% |
| G | 0.02% | 0.02% | 4.25% | 0.17% | 0.09% | 0.01% | 0.01% |
| T | 0.01% | 0.00% | 0.02% | 0.01% | 0.01% | 0.01% | 0.00% |

| HEK2-6 pNMG-341 | 2 A | 3 A | 5 A | 8 A | 9 A | 12 A | 14 A |
|---|---|---|---|---|---|---|---|
| A | 99.94% | 99.86% | 95.56% | 99.74% | 99.90% | 99.97% | 99.98% |
| C | 0.00% | 0.01% | 0.00% | 0.00% | 0.00% | 0.00% | 0.00% |
| G | 0.04% | 0.12% | 4.43% | 0.24% | 0.08% | 0.01% | 0.01% |
| T | 0.01% | 0.01% | 0.01% | 0.02% | 0.01% | 0.02% | 0.00% |

| HEK2-6 pNMG-346 | 2 A | 3 A | 5 A | 8 A | 9 A | 12 A | 14 A |
|---|---|---|---|---|---|---|---|
| A | 99.98% | 99.99% | 99.76% | 99.97% | 99.96% | 99.98% | 99.98% |
| C | 0.00% | 0.00% | 0.00% | 0.00% | 0.00% | 0.00% | 0.00% |
| G | 0.01% | 0.00% | 0.23% | 0.02% | 0.01% | 0.00% | 0.01% |
| T | 0.01% | 0.01% | 0.01% | 0.01% | 0.01% | 0.01% | 0.00% |

| HEK2-6 pNMG-347 | 2 A | 3 A | 5 A | 8 A | 9 A | 12 A | 14 A |
|---|---|---|---|---|---|---|---|
| A | 99.95% | 99.97% | 99.62% | 99.97% | 99.95% | 99.97% | 99.98% |
| C | 0.00% | 0.00% | 0.00% | 0.00% | 0.00% | 0.00% | 0.00% |
| G | 0.03% | 0.01% | 0.35% | 0.02% | 0.03% | 0.01% | 0.01% |
| T | 0.02% | 0.01% | 0.02% | 0.00% | 0.02% | 0.02% | 0.00% |

| HEK2-6 pNMG-348 | 2 A | 3 A | 5 A | 8 A | 9 A | 12 A | 14 A |
|---|---|---|---|---|---|---|---|
| A | 99.97% | 99.96% | 99.68% | 99.97% | 99.97% | 99.98% | 99.98% |
| C | 0.00% | 0.00% | 0.00% | 0.00% | 0.00% | 0.00% | 0.00% |
| G | 0.02% | 0.02% | 0.30% | 0.01% | 0.01% | 0.00% | 0.01% |
| T | 0.01% | 0.01% | 0.02% | 0.01% | 0.02% | 0.02% | 0.01% |

| HEK2-6 pNMG-349 | 2 A | 3 A | 5 A | 8 A | 9 A | 12 A | 14 A |
|---|---|---|---|---|---|---|---|
| A | 99.97% | 99.97% | 99.74% | 99.97% | 99.97% | 99.97% | 99.98% |
| C | 0.00% | 0.00% | 0.00% | 0.01% | 0.00% | 0.00% | 0.00% |
| G | 0.02% | 0.01% | 0.25% | 0.01% | 0.02% | 0.01% | 0.01% |
| T | 0.01% | 0.01% | 0.01% | 0.01% | 0.00% | 0.01% | 0.00% |

FIGURE 135

Hek2-9 site: 5'-GA$_2$A$_3$A$_4$A$_5$CA$_7$A$_8$A$_9$A$_{10}$CA$_{12}$TA$_{14}$GAGTGCTGG-3'

| HEK2-9 pNMG-339 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 99.95% | 99.90% | 99.69% | 96.43% | 99.74% | 99.76% | 99.54% | 98.67% | 99.97% | 99.97% |
| | C | 0.00% | 0.00% | 0.03% | 0.00% | 0.01% | 0.00% | 0.00% | 0.00% | 0.00% | 0.01% |
| | G | 0.04% | 0.10% | 0.28% | 3.56% | 0.24% | 0.24% | 0.46% | 1.32% | 0.01% | 0.02% |
| | T | 0.00% | 0.00% | 0.00% | 0.00% | 0.01% | 0.00% | 0.00% | 0.01% | 0.01% | 0.01% |

| HEK2-9 pNMG-340 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 99.96% | 99.97% | 99.80% | 96.26% | 99.94% | 99.92% | 99.76% | 99.33% | 99.98% | 99.97% |
| | C | 0.00% | 0.00% | 0.03% | 0.01% | 0.00% | 0.00% | 0.00% | 0.01% | 0.00% | 0.01% |
| | G | 0.03% | 0.03% | 0.17% | 3.73% | 0.05% | 0.07% | 0.24% | 0.66% | 0.01% | 0.02% |
| | T | 0.01% | 0.00% | 0.00% | 0.00% | 0.00% | 0.00% | 0.00% | 0.00% | 0.01% | 0.01% |

| HEK2-9 pNMG-341 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 99.90% | 99.85% | 99.47% | 96.53% | 99.62% | 99.65% | 99.33% | 98.64% | 99.92% | 99.97% |
| | C | 0.00% | 0.00% | 0.02% | 0.01% | 0.00% | 0.00% | 0.00% | 0.00% | 0.00% | 0.01% |
| | G | 0.10% | 0.17% | 0.51% | 3.46% | 0.37% | 0.35% | 0.66% | 1.35% | 0.06% | 0.02% |
| | T | 0.01% | 0.00% | 0.00% | 0.00% | 0.00% | 0.00% | 0.00% | 0.01% | 0.02% | 0.01% |

| HEK2-9 pNMG-346 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 99.98% | 99.98% | 99.96% | 99.90% | 99.99% | 99.98% | 99.99% | 99.95% | 99.98% | 99.98% |
| | C | 0.00% | 0.00% | 0.03% | 0.01% | 0.00% | 0.00% | 0.00% | 0.00% | 0.00% | 0.00% |
| | G | 0.01% | 0.01% | 0.01% | 0.08% | 0.01% | 0.02% | 0.01% | 0.04% | 0.01% | 0.01% |
| | T | 0.01% | 0.01% | 0.00% | 0.00% | 0.00% | 0.00% | 0.00% | 0.01% | 0.01% | 0.01% |

| HEK2-9 pNMG-347 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 100.00% | 99.98% | 99.94% | 99.76% | 99.98% | 99.97% | 99.97% | 99.93% | 99.98% | 99.97% |
| | C | 0.00% | 0.00% | 0.04% | 0.00% | 0.00% | 0.00% | 0.00% | 0.00% | 0.00% | 0.01% |
| | G | 0.00% | 0.01% | 0.04% | 0.23% | 0.01% | 0.02% | 0.03% | 0.06% | 0.01% | 0.02% |
| | T | 0.00% | 0.01% | 0.00% | 0.00% | 0.01% | 0.01% | 0.00% | 0.01% | 0.01% | 0.01% |

| HEK2-9 pNMG-348 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 99.97% | 99.98% | 99.96% | 99.86% | 99.99% | 99.98% | 99.99% | 99.96% | 99.98% | 99.94% |
| | C | 0.00% | 0.00% | 0.02% | 0.00% | 0.00% | 0.00% | 0.00% | 0.00% | 0.00% | 0.01% |
| | G | 0.01% | 0.02% | 0.02% | 0.14% | 0.01% | 0.01% | 0.01% | 0.03% | 0.00% | 0.04% |
| | T | 0.01% | 0.01% | 0.00% | 0.00% | 0.00% | 0.00% | 0.00% | 0.01% | 0.01% | 0.01% |

| HEK2-9 pNMG-349 | | 2 | 3 | 4 | 5 | 7 | 8 | 9 | 10 | 12 | 14 |
|---|---|---|---|---|---|---|---|---|---|---|---|
| | | A | A | A | A | A | A | A | A | A | A |
| | A | 99.98% | 99.98% | 99.62% | 99.66% | 99.97% | 99.98% | 99.98% | 99.63% | 99.98% | 99.96% |
| | C | 0.00% | 0.00% | 0.35% | 0.00% | 0.00% | 0.00% | 0.00% | 0.00% | 0.00% | 0.01% |
| | G | 0.01% | 0.01% | 0.03% | 0.34% | 0.02% | 0.01% | 0.01% | 0.37% | 0.01% | 0.03% |
| | T | 0.01% | 0.01% | 0.00% | 0.00% | 0.00% | 0.00% | 0.00% | 0.01% | 0.01% | 0.00% |

FIGURE 136

Hek2-10 site: 5'-GA$_2$A$_3$CA$_5$TA$_7$A$_8$A$_9$GA$_{11}$A$_{12}$TA$_{14}$GA$_{16}$ATGATGG-3'

| HEK2-10 pNMG-339 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.71% | 98.28% | 99.08% | 98.35% | 98.78% | 99.52% | 99.46% | 99.96% | 99.98% | 99.98% |
| | C | 0.00% | 0.00% | 0.00% | 0.00% | 0.00% | 0.00% | 0.01% | 0.00% | 0.00% | 0.00% |
| | G | 0.28% | 1.71% | | 1.64% | 1.21% | 0.47% | 0.52% | 0.02% | 0.01% | 0.01% |
| | T | 0.01% | 0.01% | 0.01% | 0.01% | 0.01% | 0.00% | 0.01% | 0.01% | 0.01% | 0.01% |

| HEK2-10 pNMG-340 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.87% | 99.47% | 93.87% | 99.11% | 99.59% | 99.79% | 99.75% | 99.96% | 99.97% | 99.98% |
| | C | 0.00% | 0.00% | 0.00% | 0.00% | 0.00% | 0.00% | 0.01% | 0.00% | 0.00% | 0.00% |
| | G | 0.12% | 0.52% | 6.12% | 0.89% | 0.40% | 0.20% | 0.22% | 0.02% | 0.02% | 0.01% |
| | T | 0.01% | 0.01% | 0.01% | 0.00% | 0.01% | 0.01% | 0.01% | 0.01% | 0.01% | 0.01% |

| HEK2-10 pNMG-341 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.61% | 97.96% | 84.66% | 97.06% | 98.45% | 99.40% | 99.47% | 99.97% | 99.98% | 99.98% |
| | C | 0.00% | 0.00% | 0.00% | 0.00% | 0.01% | 0.00% | 0.01% | 0.00% | 0.00% | 0.00% |
| | G | 0.39% | 2.00% | | 2.93% | 1.53% | 0.59% | 0.50% | 0.02% | 0.01% | 0.01% |
| | T | 0.01% | 0.01% | 0.01% | 0.01% | 0.01% | 0.00% | 0.01% | 0.00% | 0.01% | 0.01% |

| HEK2-10 pNMG-346 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.96% | 99.96% | 99.67% | 99.71% | 99.96% | 99.95% | 99.97% | 99.99% | 99.98% | 99.98% |
| | C | 0.00% | 0.00% | 0.00% | 0.00% | 0.00% | 0.00% | 0.02% | 0.00% | 0.00% | 0.00% |
| | G | 0.02% | 0.03% | 0.32% | 0.29% | 0.03% | 0.04% | 0.01% | 0.01% | 0.01% | 0.01% |
| | T | 0.01% | 0.01% | 0.01% | 0.00% | 0.01% | 0.01% | 0.01% | 0.01% | 0.01% | 0.01% |

| HEK2-10 pNMG-347 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.98% | 99.93% | 99.06% | 99.56% | 99.93% | 99.95% | 99.97% | 99.99% | 99.97% | 99.98% |
| | C | 0.00% | 0.00% | 0.00% | 0.00% | 0.00% | 0.00% | 0.02% | 0.00% | 0.00% | 0.00% |
| | G | 0.01% | 0.06% | 0.93% | 0.43% | 0.06% | 0.04% | 0.01% | 0.01% | 0.02% | 0.01% |
| | T | 0.01% | 0.01% | 0.01% | 0.00% | 0.01% | 0.01% | 0.01% | 0.01% | 0.01% | 0.01% |

| HEK2-10 pNMG-348 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.96% | 99.94% | 98.39% | 99.50% | 99.92% | 99.97% | 99.97% | 99.99% | 99.98% | 99.98% |
| | C | 0.00% | 0.00% | 0.00% | 0.00% | 0.00% | 0.00% | 0.02% | 0.00% | 0.00% | 0.00% |
| | G | 0.03% | 0.05% | 1.59% | 0.49% | 0.08% | 0.02% | 0.01% | 0.01% | 0.01% | 0.01% |
| | T | 0.01% | 0.01% | 0.01% | 0.01% | 0.00% | 0.00% | 0.01% | 0.01% | 0.01% | 0.01% |

| HEK2-10 pNMG-349 | | 2 | 3 | 5 | 7 | 8 | 9 | 11 | 12 | 14 | 16 |
|---|---|---|---|---|---|---|---|---|---|---|---|
| | | A | A | A | A | A | A | A | A | A | A |
| | A | 99.98% | 99.94% | 98.75% | 99.24% | 99.93% | 99.96% | 99.96% | 99.99% | 99.98% | 99.98% |
| | C | 0.00% | 0.00% | 0.00% | 0.00% | 0.00% | 0.01% | 0.03% | 0.00% | 0.00% | 0.00% |
| | G | 0.01% | 0.04% | 1.24% | 0.46% | 0.06% | 0.02% | 0.01% | 0.01% | 0.01% | 0.01% |
| | T | 0.01% | 0.01% | 0.01% | 0.01% | 0.00% | 0.01% | 0.01% | 0.00% | 0.01% | 0.01% |

FIGURE 137

Hek3- 5'-GGCCCA GA CTGA GCA CGTGATGG-3'

| HEK3 pNMG-338 | | 6<br>A | 8<br>A | 12<br>A | 15<br>A |
|---|---|---|---|---|---|
| | A | | | | |
| | C | 0.00% | 0.00% | 0.00% | 0.00% |
| | G | 2.02% | 5.15% | 0.04% | 0.01% |
| | T | 0.01% | 0.01% | 0.00% | 0.01% |

| HEK3 pNMG-346 | | 6<br>A | 8<br>A | 12<br>A | 15<br>A |
|---|---|---|---|---|---|
| | A | | | | |
| | C | 0.00% | 0.00% | 0.00% | 0.00% |
| | G | 0.12% | 0.23% | 0.05% | 0.01% |
| | T | 0.01% | 0.01% | 0.00% | 0.01% |

| HEK3 pNMG-340 | | 6<br>A | 8<br>A | 12<br>A | 15<br>A |
|---|---|---|---|---|---|
| | A | | | | |
| | C | 0.00% | 0.00% | 0.00% | 0.00% |
| | G | 1.03% | 3.43% | 0.04% | 0.01% |
| | T | 0.01% | 0.00% | 0.01% | 0.01% |

| HEK3 pNMG-347 | | 6<br>A | 8<br>A | 12<br>A | 15<br>A |
|---|---|---|---|---|---|
| | A | | | | |
| | C | 0.00% | 0.00% | 0.00% | 0.00% |
| | G | 0.26% | 0.56% | 0.03% | 0.01% |
| | T | 0.01% | 0.01% | 0.01% | 0.01% |

| HEK3 pNMG-341 | | 6<br>A | 8<br>A | 12<br>A | 15<br>A |
|---|---|---|---|---|---|
| | A | | | | |
| | C | 0.00% | 0.00% | 0.00% | 0.00% |
| | G | 2.26% | 5.30% | 0.03% | 0.01% |
| | T | 0.01% | 0.01% | 0.01% | 0.01% |

| HEK3 pNMG-348 | | 6<br>A | 8<br>A | 12<br>A | 15<br>A |
|---|---|---|---|---|---|
| | A | | | | |
| | C | 0.00% | 0.00% | 0.00% | 0.00% |
| | G | 0.22% | 0.37% | 0.04% | 0.00% |
| | T | 0.02% | 0.01% | 0.00% | 0.01% |

| HEK3 pNMG-349 | | 6<br>A | 8<br>A | 12<br>A | 15<br>A |
|---|---|---|---|---|---|
| | A | | | | |
| | C | 0.00% | 0.00% | 0.00% | 0.00% |
| | G | 0.14% | 0.53% | 0.02% | 0.00% |
| | T | 0.01% | 0.01% | 0.00% | 0.01% |

FIGURE 138

RNF2- 5'-GTCA TCTTA GTCA TTA CCTGAGG-3'
         4    9    13   16

| RNF2 pNMG-339 | 4 A | 9 A | 13 A | 16 A |
|---|---|---|---|---|
| A | 99.21% | 98.98% | 99.98% | 99.97% |
| C | 0.00% | 0.02% | 0.00% | 0.00% |
| G | 0.78% | 0.99% | 0.01% | 0.02% |
| T | 0.01% | 0.01% | 0.01% | 0.01% |

| RNF2 pNMG-346 | 4 A | 9 A | 13 A | 16 A |
|---|---|---|---|---|
| A | 99.97% | 99.94% | 99.98% | 99.98% |
| C | 0.00% | 0.02% | 0.00% | 0.00% |
| G | 0.02% | 0.04% | 0.01% | 0.01% |
| T | 0.01% | 0.01% | 0.01% | 0.01% |

| RNF2 pNMG-340 | 4 A | 9 A | 13 A | 16 A |
|---|---|---|---|---|
| A | 99.75% | 99.69% | 99.99% | 99.98% |
| C | 0.00% | 0.01% | 0.00% | 0.00% |
| G | 0.24% | 0.29% | 0.01% | 0.01% |
| T | 0.01% | 0.01% | 0.01% | 0.01% |

| RNF2 pNMG-347 | 4 A | 9 A | 13 A | 16 A |
|---|---|---|---|---|
| A | 99.95% | 99.90% | 99.98% | 99.98% |
| C | 0.00% | 0.01% | 0.00% | 0.00% |
| G | 0.04% | 0.08% | 0.01% | 0.01% |
| T | 0.01% | 0.01% | 0.01% | 0.01% |

| RNF2 pNMG-341 | 4 A | 9 A | 13 A | 16 A |
|---|---|---|---|---|
| A | 99.86% | 98.94% | 99.97% | 99.97% |
| C | 0.00% | 0.02% | 0.00% | 0.00% |
| G | 1.12% | 1.03% | 0.01% | 0.02% |
| T | 0.02% | 0.01% | 0.01% | 0.01% |

| RNF2 pNMG-348 | 4 A | 9 A | 13 A | 16 A |
|---|---|---|---|---|
| A | 99.93% | 98.96% | 99.97% | 99.97% |
| C | 0.00% | 0.01% | 0.00% | 0.00% |
| G | 0.06% | 0.02% | 0.01% | 0.02% |
| T | 0.01% | 0.00% | 0.01% | 0.01% |

| RNF2 pNMG-349 | 4 A | 9 A | 13 A | 16 A |
|---|---|---|---|---|
| A | 99.94% | 99.95% | 99.98% | 99.98% |
| C | 0.00% | 0.02% | 0.00% | 0.00% |
| G | 0.05% | 0.02% | 0.01% | 0.01% |
| T | 0.01% | 0.00% | 0.01% | 0.01% |

FIGURE 139
FANCF- 5'-GGA₃A₄TCCCTTCTGCA₁₅GCA₁₈CCTGG-3'

| FanCF pNMG-339 | | 3 A | 4 A | 15 A | 18 A |
|---|---|---|---|---|---|
| | A | 99.72% | 99.46% | 99.98% | 99.98% |
| | C | 0.01% | 0.01% | 0.00% | 0.00% |
| | G | 0.26% | 1.52% | 0.02% | 0.01% |
| | T | 0.01% | 0.01% | 0.00% | 0.01% |

| FanCF pNMG-346 | | 3 A | 4 A | 15 A | 18 A |
|---|---|---|---|---|---|
| | A | 99.97% | 99.85% | 99.98% | 99.98% |
| | C | 0.01% | 0.01% | 0.00% | 0.00% |
| | G | 0.01% | 0.13% | 0.02% | 0.01% |
| | T | 0.01% | 0.01% | 0.00% | 0.01% |

| FanCF pNMG-340 | | 3 A | 4 A | 15 A | 18 A |
|---|---|---|---|---|---|
| | A | 99.95% | 99.50% | 99.98% | 99.98% |
| | C | 0.01% | 0.01% | 0.00% | 0.00% |
| | G | 0.04% | 0.48% | 0.01% | 0.00% |
| | T | 0.01% | 0.00% | 0.00% | 0.01% |

| FanCF pNMG-347 | | 3 A | 4 A | 15 A | 18 A |
|---|---|---|---|---|---|
| | A | 99.95% | 99.65% | 99.98% | 99.98% |
| | C | 0.00% | 0.00% | 0.00% | 0.00% |
| | G | 0.04% | 0.34% | 0.02% | 0.00% |
| | T | 0.01% | 0.00% | 0.01% | 0.01% |

| FanCF pNMG-341 | | 3 A | 4 A | 15 A | 18 A |
|---|---|---|---|---|---|
| | A | 99.69% | 99.46% | 99.98% | 99.98% |
| | C | 0.01% | 0.01% | 0.00% | 0.00% |
| | G | 0.29% | 1.52% | 0.02% | 0.01% |
| | T | 0.01% | 0.00% | 0.00% | 0.01% |

| FanCF pNMG-348 | | 3 A | 4 A | 15 A | 18 A |
|---|---|---|---|---|---|
| | A | 99.94% | 99.08% | 99.98% | 99.98% |
| | C | 0.00% | 0.00% | 0.00% | 0.00% |
| | G | 0.05% | 0.90% | 0.01% | 0.01% |
| | T | 0.01% | 0.01% | 0.00% | 0.01% |

| FanCF pNMG-349 | | 3 A | 4 A | 15 A | 18 A |
|---|---|---|---|---|---|
| | A | 99.93% | 99.33% | 99.98% | 99.98% |
| | C | 0.01% | 0.01% | 0.00% | 0.00% |
| | G | 0.05% | 0.65% | 0.01% | 0.01% |
| | T | 0.01% | 0.01% | 0.00% | 0.01% |

| sgRNA | site | 107 | 108 | 109 | 142 | 144 | 177 | 335 | 370 | 371 | 460 | 464 | 476 | 477 | 479 | 482 | 488 | 493 | 497 | 498 | 500 | BE3 | BE3B | Cas9 (indel) % |
|---|---|---|---|---|---|---|---|---|---|---|---|---|---|---|---|---|---|---|---|---|---|---|---|---|
| 200 | GAACA...CAAAGCATAGACTGC | 0.2 | 0.2 | 1.0 | 0.3 | 2.9 | 14.8 | 0.4 | 52.5 | 57.7 | 54.0 | 65.8 | 62.9 | 64.0 | 61.0 | 0.7 | 39.3 | 34.1 | 45.8 | 56.5 | 29.6 | | | 22.82 |
| 201 | GAACAC..AAAGCATAGACTGC | | | | | | | | | | | | | | | | | | | | | 38.9 | 45.4 | |
| 202 | GGGGGA..CGCGCTGGCTTCCCG | 0.1 | 0.0 | 0.0 | 0.1 | 0.3 | 1.2 | 0.0 | 2.0 | 3.6 | 4.0 | 3.1 | 6.1 | 8.1 | 4.9 | 0.1 | 2.7 | 4.6 | 3.2 | 4.4 | 1.3 | | | 31.88 |
| 204 | GCCA..CTTCTAAGCCCTTGAT | 0.0 | 0.0 | 0.0 | 0.0 | 0.3 | 1.3 | 0.0 | 4.3 | 21.3 | 19.2 | 15.8 | 7.2 | 8.6 | 6.0 | 0.0 | 3.6 | 4.6 | 3.2 | 4.4 | 1.3 | 32.5 | 34.8 | |
| 204 | GCCACTTC..TAAGCCCTTGAT | | | | | | | | | | | | | | | | | | | | | | | |
| 208 | GATGA..GATAATGATGAGTCA | 0.0 | 0.0 | 0.0 | 0.1 | 0.2 | 2.7 | 0.0 | 2.6 | 3.6 | 4.2 | 3.6 | 12.9 | 10.9 | 12.1 | 0.0 | 5.4 | 8.9 | 10.1 | 12.5 | 2.6 | | | 39.19 |
| 208 | GATGAGA..TAATGATGAGTCA | 0.0 | 0.0 | 0.0 | 0.0 | 0.6 | 0.9 | 0.0 | 1.5 | 4.1 | 4.3 | 5.0 | 5.0 | 4.9 | 4.2 | 0.0 | 5.2 | 7.8 | 3.4 | 4.5 | 1.5 | | | |
| 208 | GCCTA..GGCAGTGGGGGTGCA | 0.0 | 0.0 | 0.0 | 0.0 | 0.1 | 0.4 | 0.0 | 0.7 | 1.4 | 1.5 | 1.0 | 3.8 | 5.2 | 3.2 | 0.0 | 0.3 | 1.0 | 4.0 | 3.9 | 0.9 | | | 17.10 |
| 209 | GCCCTAGGGCAGTGGGGGTGCA | | | | | | | | | | | | | | | | | | | | | 8.1 | 0.3 | |
| 469 | GAGTA..TGAGGCATAGACTGC | 0.2 | 0.2 | 0.1 | 0.3 | 0.8 | 5.7 | 0.0 | 7.4 | 26.7 | 28.8 | 20.3 | 37.7 | 42.3 | 0.3 | 0.3 | 5.9 | 13.0 | 30.4 | 32.7 | 11.2 | | | |

Figure 142

| construct | HEK2 | Site 2 | site 4 | site 8 | site 9 |
|---|---|---|---|---|---|
| 107 | 0.00 | 0.01 | 0.01 | 0.06 | 0.06 |
| 108 | 0.53 | 0.18 | 0.02 | 0.02 | 0.10 |
| 109 | 0.01 | 0.03 | 0.04 | 0.05 | 0.00 |
| 142 | 0.05 | 0.01 | 0.03 | 0.13 | 0.10 |
| 144 | 0.00 | 0.07 | 0.01 | 0.02 | 0.02 |
| 177 | 0.12 | 0.12 | 0.08 | 0.03 | 0.04 |
| 335 | 0.04 | 0.03 | 0.04 | 0.00 | 0.04 |
| 370 | 0.32 | 0.09 | 0.09 | 0.01 | 0.03 |
| 371 | 0.36 | 0.17 | 0.23 | 0.09 | 0.03 |
| 402 | 0.26 | 0.16 | 0.33 | 0.00 | 0.01 |
| 404 | 0.13 | 0.17 | 0.12 | 0.11 | 0.02 |
| 476 | 0.01 | 0.14 | 0.05 | 0.00 | 0.10 |
| 477 | 0.05 | 0.10 | 0.07 | 0.09 | 0.06 |
| 478 | 0.03 | 0.20 | 0.07 | 0.03 | 0.02 |
| 482 | 0.03 | 0.16 | 0.02 | 0.09 | 0.16 |
| 494 | 0.00 | 0.11 | 0.11 | 0.08 | 0.01 |
| 492 | 0.43 | | 0.07 | 0.02 | 0.03 |
| 497 | 0.05 | | 0.05 | 0.07 | 0.12 |
| 498 | 0.13 | | 0.08 | 0.05 | 0.14 |
| 500 | 0.01 | | 0.03 | 0.05 | 0.01 |
| BE3 | 1.05 | | 1.69 | 0.13 | 0.20 |
| BE3B | 6.34 | | 6.90 | 0.13 | 0.18 |
| Cas9 | 28.92 | | 31.98 | 39.19 | 17.16 |

Figure 143

| sgRNA | site | 482 | 476 | 476+274 | 476+275 | 477 | 477+274 | 477+275 | 285b | 285b+274 | 285b+275 | 277 |
|---|---|---|---|---|---|---|---|---|---|---|---|---|
| 299 | GAACACAAAGCATAGACTGC | 1.9 | 67.5 | 59.6 | 51.2 | 72.9 | 63.9 | 60.1 | 30.8 | 31.2 | 27.0 | 46.2 |
| 301 | GGAACACAAAGCATAGACTG | 0.3 | 29.5 | 23.3 | 18.5 | 37.1 | 24.6 | 32.0 | 16.9 | 14.5 | 12.5 | 19.9 |
| 301 | GGAACACAAAGCATAGACTG | 2.8 | 53.0 | 38.3 | 33.7 | 61.0 | 44.3 | 47.6 | 19.7 | 17.1 | 15.4 | 24.4 |
| 502 | CGGGAACCGGCTGGCTTCCG | 0.0 | 4.1 | 4.7 | 3.6 | 3.5 | 4.1 | 3.1 | 2.7 | 2.0 | 1.3 | 1.0 |
| 505 | CGGAAGACCCAGCATCCGT | 0.0 | 0.1 | 0.2 | 0.2 | 0.2 | 0.1 | 0.8 | 0.6 | 0.0 | 0.0 | 0.0 |
| 505 | CGGAAGAGACCCAGCATCCGT | 0.0 | 0.6 | 0.6 | 0.1 | 1.1 | 0.2 | 0.2 | 1.2 | 0.1 | 0.1 | 0.5 |
| 505 | CGGAAAGACCCAGCATCCGT | 0.0 | 1.4 | 0.1 | 0.3 | 0.3 | 1.2 | 0.8 | 0.6 | 0.6 | 0.4 | 0.0 |
| 505 | CGGAAAGAACCCAGCATCCGT | 0.7 | 3.1 | 1.3 | 1.2 | 3.2 | 1.4 | 1.9 | 0.5 | 0.1 | 0.2 | 0.6 |
| 507 | GAAACTGGTCCGTTTACAG | 0.0 | 0.5 | 0.2 | 0.1 | 0.5 | 0.5 | 0.3 | 0.5 | 0.5 | 0.2 | 0.3 |
| 509 | GCCTAAGGCAGTGGGGTGCA | 0.0 | 7.7 | 2.0 | 2.0 | 3.8 | 1.7 | 2.0 | 1.3 | 0.1 | 0.7 | 0.7 |

Figure 144

| Site | Protospacer and PAM sequence | 371 | 402 | 404 | 410 | 476 | 477 | 478 | 479 | |
|---|---|---|---|---|---|---|---|---|---|---|
| CAC (HeK2) | GAACACAAAGCATAGACTGCTGG | 46.4 | 48.1 | 41.0 | 46.2 | 51.8 | 39.6 | 45.8 | 35.2 | 47.5 |
| AAA | GAAAAAAAGCAGAGACTGCTGG | 0.1 | 0.1 | 0.0 | 0.1 | 0.2 | 0.3 | 0.2 | 0.0 | |
| TAC | GAATACTAAGCATAGACTCCAGG | 37.7 | 39.9 | 38.5 | 43.4 | 45.1 | 41.4 | 38.3 | 25.7 | |
| AAC | GTAAACAAGGCATAGACTGAGG | 17.8 | 21.8 | 16.9 | 19.5 | 14.1 | 14.8 | 14.2 | 9.7 | |
| GAC | GAAGACCAAGGATAGACTGCTGG | 7.7 | 6.5 | 4.7 | 11.4 | 7.6 | 9.3 | 7.4 | 2.3 | |
| CAT | GAACATAAAGAATAGAATGATGG | 16.4 | 20.8 | 16.0 | 21.7 | 16.7 | 22.3 | 21.3 | 12.9 | |
| CAG | GGACAGGCAGGCATAGACTGTGG | 9.6 | 16.9 | 9.4 | 13.7 | 24.9 | 22.7 | 29.0 | 26.7 | |
| GAA | GTAGAAAAGTATAGACTGCAGG | 2.9 | 2.8 | 2.5 | 4.8 | 8.7 | 6.4 | 6.0 | 3.7 | 11.1 |
| GAG | GGAGAGAAAGCATAGACTGCTGG | 7.6 | 10.6 | 5.6 | 10.4 | 16.5 | 26.0 | 14.1 | 9.2 | 0.5 |
| GAT | GAAGATAGAGAATAGACTGCTGG | 2.6 | 4.1 | 2.2 | 6.1 | 7.1 | 7.3 | 5.6 | 3.2 | 9.8 |
| TAA | GGCTAAAGACCATAGACTGTGG | 2.3 | 3.7 | 1.8 | 2.3 | 4.2 | 5.6 | 4.1 | 2.2 | 31.4 |
| TAG | GTCTAGAAAGCTTAGACTGCTGG | 10.1 | 14.9 | 8.1 | 9.1 | 24.3 | 28.3 | 20.3 | 13.6 | 11.7 |
| TAT | GAGTATGAGGCATAGACTGCAGG | 21.0 | 38.1 | 18.3 | 32.3 | 37.0 | 40.3 | 40.1 | 28.4 | 18.7 |
| AAG | GTCAAGAAAGCAGAGACTGCCGG | 6.1 | 6.5 | 5.6 | 10.7 | 11.9 | 12.6 | 9.8 | 7.8 | |
| AAT | GGGAATAAATCATAGAATCCTGG | 5.9 | 11.2 | 6.4 | 16.7 | 20.1 | 15.3 | 16.0 | 11.1 | 0.3 |
| CAA | GAGCAAAGAGAATAGACTGTAGG | 2.5 | 5.4 | 2.8 | 3.2 | 7.4 | 13.3 | 6.9 | 6.2 | |

Figure 145

| sgRNA | site | ABE2 | ABE3 | ABE4 | ABE5-1 | ABE5-2 | ABE5-3 |
|---|---|---|---|---|---|---|---|
| 299 | GAACA₄CAAAGCATAGACTGC | 13.6 | 58.5 | 54.4 | 77.6 | 69.5 | 57.3 |
| 502 | GGGGA₄CGCGCTGCTTCCCG | 0.9 | 5.6 | 3.0 | 5.8 | 3.0 | 3.3 |
| 504 | GCCA₄CTTCTAAGCCCTTGAT | 1.0 | 7.4 | 4.2 | 7.6 | 5.1 | 5.4 |
| 505 | GGGA₄AGACCCAGCATCCGT | 0.1 | 0.2 | 0.7 | 0.3 | 0.1 | 0.3 |
| 505 | GGGAA₄AGACCCAGCATCCGT | 0.1 | 0.4 | 0.5 | 0.5 | 0.2 | 1.0 |
| 505 | GGGAAA₄GACCCAGCATCCGT | 0.3 | 0.6 | 0.4 | 0.2 | 0.2 | 0.5 |
| 505 | GGGAAAGA₄CCCAGCATCCGT | 0.6 | 1.5 | 1.5 | 3.0 | 1.3 | 3.6 |
| 507 | GAAA₄CTGGTCCCGTTACAG | 0.1 | 0.6 | 0.3 | 0.9 | 0.4 | 0.6 |
| 508 | GATGA₄GATAATGATGAGTCA | 1.7 | 11.5 | 0.4 | 15.6 | 8.8 | 6.1 |
| 508 | GATGAGA₄TAATGATGAGTCA | 1.4 | 5.1 | 0.1 | 6.0 | 3.5 | 4.7 |
| 509 | GCCTA₄GGCAGTGGGGTGCA | 0.2 | 3.1 | 0.6 | 5.9 | 2.3 | 1.3 |

Figure 149

DNA Shuffle (NeXT)

1. generated shuffled library including constructs from evo #4, 5a, 5b and evo #2

2. transformed library into S1030 + pNMG-333 selection plasmid 3. induce ABE expression for 7h and plated on selection conditions:
   a. 128 ug/mL chlor
   b. 192 ug/mL chlor
   c. 384 ug/mL spect
   d. 256 ug/mL spect, 64 ug/mL chlor 4. selection plate incubated at 37°C, 48h → surviving colonies sequenced Spect target: 5'--CAATGATGACTTCTACAGCG--3'

Chlor target: 5'--TACGGCCTAGTGCAACCTGGA--3' outcome:

* >95% of clones surviving on chlor and chlor + spect plates (200 colonies sequenced total) contained Evo #3 mutations only

* clones sequenced from spect only selection condition, however, had high frequency of mutation at A142 and A143, also high frequency of mutations in C-terminal portion of eTadA (K157, Q159, E160 and K161) – see chart on next slide

* clones sequenced from spect only selection condition had a low relative frequency of evo #3 mutations only (<10% of total constructs sequenced) – very different outcome than colonies sequenced from chlor only plates.

Figure 151

Figure 155:
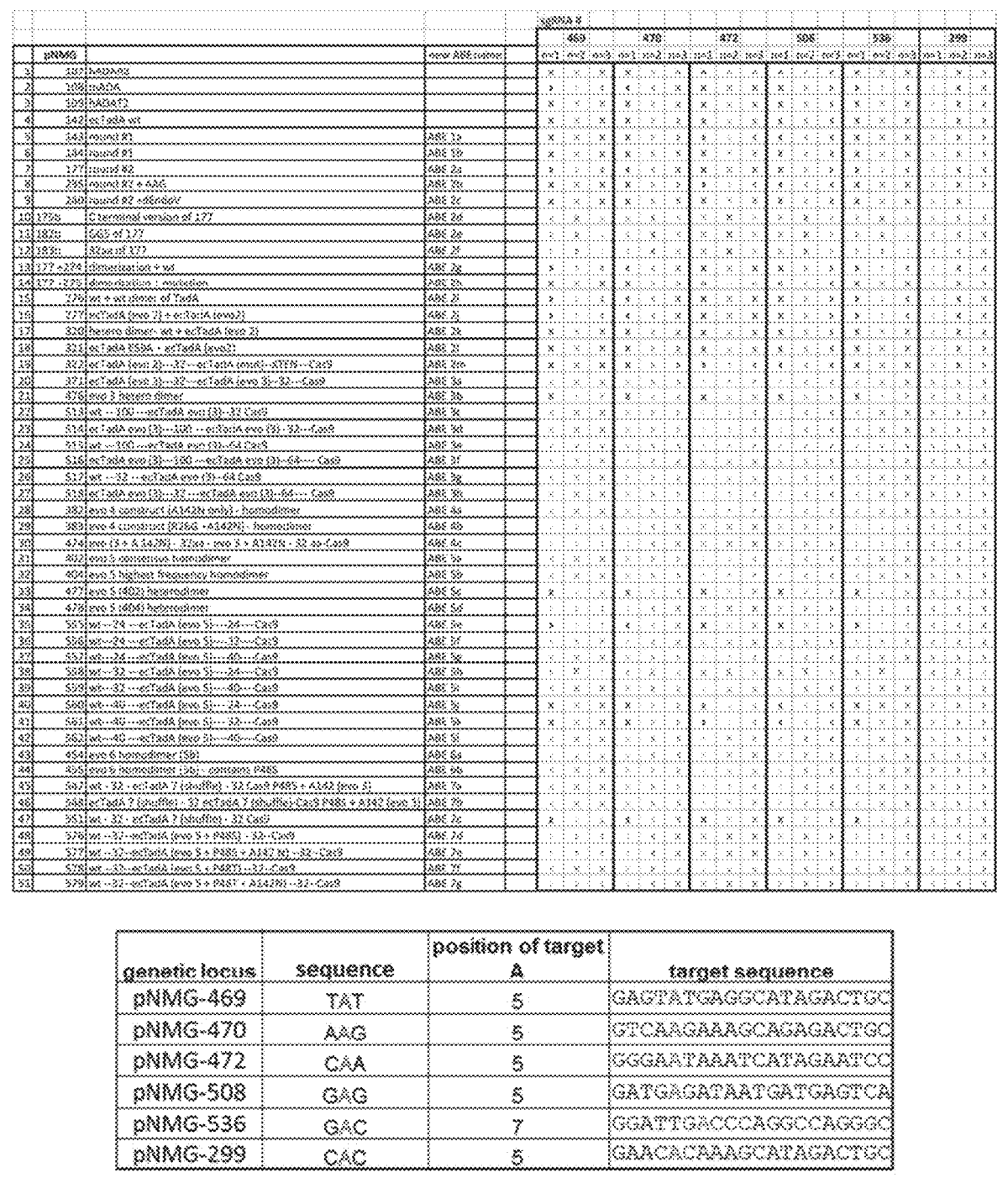

| genetic locus | sequence | position of target A | target sequence |
|---|---|---|---|
| pNMG-469 | TAT | 5 | GAGTATGAGGCATAGACTGC |
| pNMG-470 | AAG | 5 | GTCAAGAAAGCAGAGACTGC |
| pNMG-472 | CAA | 5 | GGGAATAAATCATAGAATCC |
| pNMG-508 | GAG | 5 | GATGAGATAATGATGAGTCA |
| pNMG-536 | GAC | 7 | GGATTGACCCAGGCCAGGGC |
| pNMG-299 | CAC | 5 | GAACACAAAGCATAGACTGC |

Correction of: 5'-TTCATTA(7)ACTGTGGCCGGCT-3'
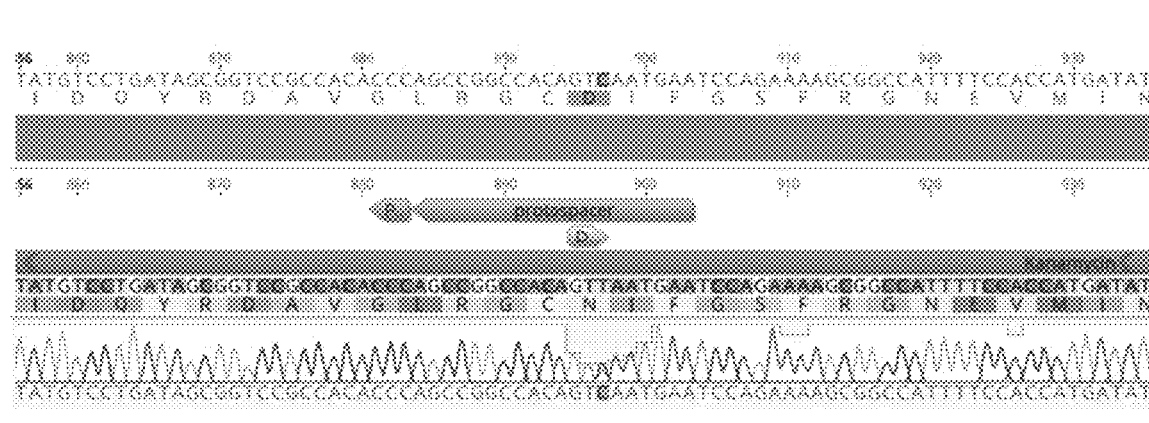
Correction of: 5'-ATCTTA(6)TTCGATCATGCGAA-3'
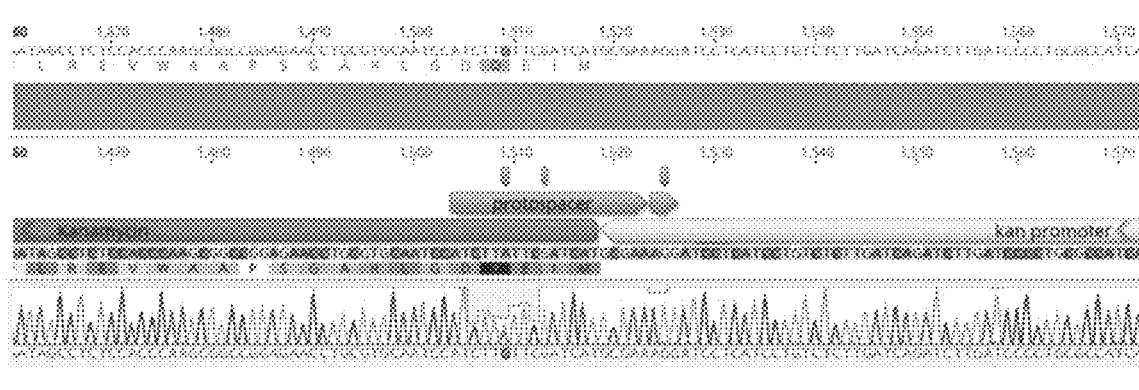
Figure 163

| position: | 17 | 23 | 48 | 111 | 118 | 122 | 123 | 125 | 126 | 147 | 152 | 155 | 156 | 161 | 164 |
|---|---|---|---|---|---|---|---|---|---|---|---|---|---|---|---|
| wt res: | Thr | Trp | Pro | Thr | Met | His | His | Gly | Met | Asp | Arg | Glu | Ile | Lys | Ser |
| | Ser | Leu | Ala | | | | | | | | | | | | |
| | | | Ala | | | Asn | | | | | | | | | |
| | | | Ala | Ser | | | | | | | | | | | |
| | Ser | | Ala | | | | | | | | | | | Thr | Tyr |
| | | | Ser | | | | | | | | | | | | |
| | | | Ser | | | | | | | | Pro | | | | |
| | | | Ala | | | | | | Leu | | | | | Thr | |
| | Ser | Leu | Ser | | | | | | | | | | | Thr | |
| | | | Ala | | | | | | Leu | | | | | Thr | |
| | | Leu | Ala | | | | | | | | | | | Thr | |
| | | | | | Leu | | | | | | | | | | |
| | Ser | Leu | Ala | | | | | | | | | | | | |
| | | | Ala | | | | | | | | | His | | Thr | |
| | | | Ala | | | | | | | | | Pro | | | |
| | Ser | Leu | Ala | | | | | Ala | | | | | | Thr | |
| | Ser | Leu | Ala | | | | | | | | | | | Thr | |
| | | | | | | | | | | | | Pro | | | Asn |
| | | | Ala | | | | | | | | | Pro | | | |
| | | | Ala | | | | | | | | | | | | |
| | | Arg | Ala | | | | | | | | | | | | |

| sgRNA plasmid | protospacer | %editing | ABE | cell line |
|---|---|---|---|---|
| pNMG-510 | GACTCAGATAAGATGCTGAGG | <0.15% | pNMG-478 | R196* TP53 (Calu-6) |
| pNMG-511 | GCATATGTAACAGTTCCTGCA | <0.80% | pNMG-402 | M237I TP53 (T98G) |
| pNMG-512 | GTGCATGTTGTGCCTGTCC | <0.13% | pNMG-477 | R273H TP53 (NCI-H1975) |

```
HEK2: GAACACAAAGCATAGACTGCGGG       GAG: GGAGAGAGCATAGACTGCTGG
AAA:  GAAAAAAAGCAGAGACTGCTGG        GAT: GAAGATAGAGAATAGACTGCTGG
TAC:  GAATACTAAGCATAGACTCCAGG       GAA: GTAGAAAAGTATAGACTGCAGG
AAC:  GTAAACAAAGCATAGACTGAGGG       AAG: GTCAAGAAAGCAGAGACTGCCGG
GAC:  GAAGACCAAGTATAGACTGCTGG       TAT: GAGTATGAGGCATAGACTGCAGG
CAT:  GAACATAAAGAATAGAATGATGG       TAG: GTGTAGAAAGCTTAGACTGCTGG
                                    CAG: GGACAGGCAGCATAGACTGTGGG
                                    CAA: GAGCAAGAGAATAGACTGTAGG
                                    TAA: GGCTAAAGACCATAGACTGTGGG
                                    AAT: GGGAATAAATCATAGAATCCTGG
```

Figure 178

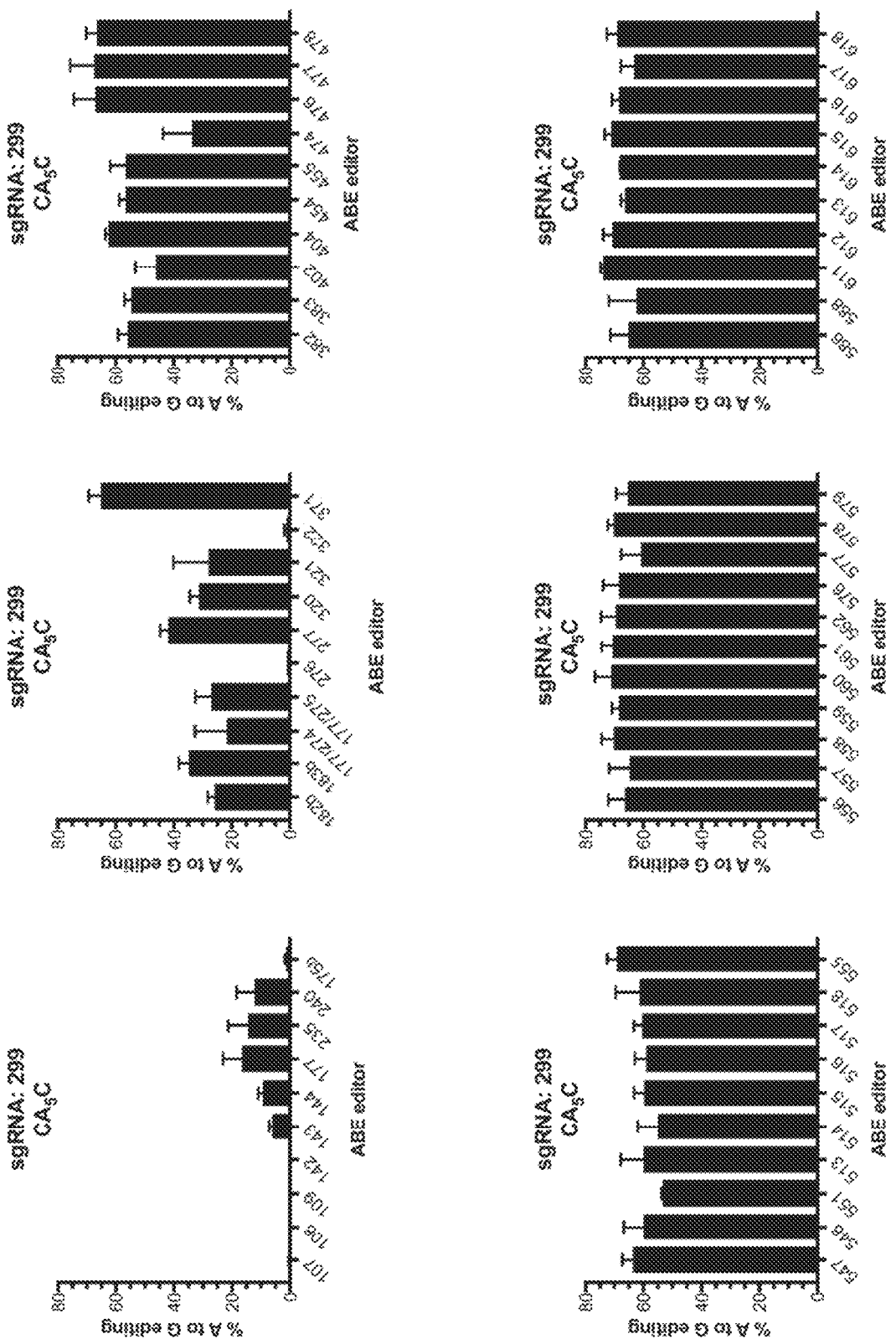
sgRNA 299: 5'-GAACACAAAGCATAGACTGC-3'  Figure 179

ADENOSINE NUCLEOBASE EDITORS AND USES THEREOF

RELATED APPLICATIONS

This application is a continuation of and claims priority under 35 U.S.C. § 120 to U.S. patent application U.S. Ser. No. 17/148,059, filed Jan. 13, 2021, which is a continuation of and claims priority under 35 U.S.C. § 120 to U.S. patent application U.S. Ser. No. 16/143,370, filed Sep. 26, 2018, which is a continuation of and claims priority under 35 U.S.C. § 120 to U.S. patent application U.S. Ser. No. 15/791,085, filed Oct. 23, 2017, which claims priority under 35 U.S.C. § 120 and 365(c) to and is a continuation of international PCT Application, PCT/US2017/045381, filed Aug. 3, 2017, which claims priority under 35 U.S.C. § 119(e) to U.S. Provisional Applications, U.S. Ser. No. 62/473,714, filed Mar. 20, 2017, U.S. Ser. No. 62/454,035, filed Feb. 2, 2017, and U.S. Ser. No. 62/370,684, filed Aug. 3, 2016, each of which is incorporated herein by reference.

REFERENCE TO AN ELECTRONIC SEQUENCE LISTING

The contents of the electronic sequence listing (H082470244US06-SUBSEQ-AZW.xml; Size: 5,355,194 bytes; and Date of Creation: Mar. 1, 2023) is herein incorporated by reference in its entirety.

BACKGROUND OF THE INVENTION

Targeted editing of nucleic acid sequences, for example, the targeted cleavage or the targeted introduction of a specific modification into genomic DNA, is a highly promising approach for the study of gene function and also has the potential to provide new therapies for human genetic diseases. Since many genetic diseases in principle can be treated by effecting a specific nucleotide change at a specific location in the genome (for example, an A to G or a T to C change in a specific codon of a gene associated with a disease), the development of a programmable way to achieve such precise gene editing represents both a powerful new research tool, as well as a potential new approach to gene editing-based therapeutics.

SUMMARY OF THE INVENTION

Provided herein are compositions, kits, and methods of modifying a polynucleotide (e.g., DNA) using an adenosine deaminase and a nucleic acid programmable DNA binding protein (e.g., Cas9) Some aspects of the disclosure provide nucleobase editing proteins which catalyze hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). To overcome this drawback, the first deoxyadenosine deaminases were evolved to accept DNA substrates and deaminate deoxyadenosine (dA) to deoxyinosine. The adenosine deaminase acting on tRNA (ADAT) from *Escherichia coli* (TadA, for tRNA adenosine deaminase A), was covalently fused to a dCas9 domain, and libraries of this fusion were assembled containing mutations in the deaminase portion of the construct. It should be appreciated that *E. coli* TadA (ecTadA) deaminases also include truncations of ecTadA. For example, truncations (e.g., N-terminal truncations) of a full length ecTadA (SEQ ID NO: 84), such as the N-terminally truncated ecTadA set forth in SEQ ID NO: 1 are provided herein for use in the present invention. Further, it was found that other adenosine deaminase mutants, such as *S. aureus* TadA mutants, were capable of deaminating adenosine. Without wishing to be bound by any particular theory, truncations of adenosine deaminases (e.g., ecTadA) may have desired solubility and/or expression properties as compared to their full-length counterparts.

Mutations in the deaminase domain of nucleobase editing proteins were made by evolving adenosine deaminases. Productive variants were identified via selection for A to G reversion at the codon of an active-site His in the acetyltransferase gene of chloramphenicol (encoded on a co-transformed selection plasmid). A first round of evolution yielded an ecTadA variant, ecTadA D108X (X=G, V, or N), capable of converting A to G in DNA. In some embodiments, the ecTadA variant comprises a D108A mutation in SEQ ID NO: 1, or a corresponding mutation in another adenosine deaminase. The first round of evolution also yielded an ecTadA variant, ecTadA A106V. A subsequent round of evolution resulted in another variant, ecTadA D108N_E155X (X=G, V, or D), which *E. coli* survive in the presence of high concentrations of chloramphenicol. Additional variants were identified by evolving ecTadA. For example, ecTadA variants that are capable of deaminating adenosine in DNA include one or more of the following mutations D108N, A106V, D147, E155V, L84F, H123Y, and I157F of SEQ ID NO: 1. It should be appreciated however, that homologous mutations may be made in other adenosine deaminases to generate variants that are capable of deaminating adenosine in DNA. Additional rounds of evolution provided further ecTadA variants. For example, additional ecTadA variants are shown in FIGS. 11, 16, 97, 104-106, 125-128, 115 and Table 4.

In the examples provided herein, exemplary nucleobase editors having the general structure evolved ecTadA (D108X; X=G, V, or N)-XTEN-nCas9, catalyzed A to G transition mutations in cells such as eukaryotic cells (e.g., Hek293T mammalian cells). In other examples exemplary nucleobase editors contain two ecTadA domains and a nucleic acid programmable DNA binding protein (napDNAbp). For example, nucleobase editors may have the general structure ecTadA(D108N)-ecTadA(D108N)-nCas9. Additional examples of nucleobase editors containing ecTadA variants provided herein demonstrate an improvement in performance of the nucleobase editors in mammalian cells. For example, certain adenosine base editors include ecTadA having D108X, where X=G, V, or N, and/or E155X, where X=B, V, or D mutations in ecTadA as set forth in SEQ ID NO: 1 or another adenine deaminase. In certain embodiments mutants, nucleobase editors are covalently fused to catalytically dead alkyl adenosine gylcosylase (AAG), which may protect the edited inosine from base excision repair (or other DNA repair systems) until the T on the opposite strand is changed to a C, for example, through mismatch repair (or other DNA repair systems). Once the base opposite the inosine is changed to a C, then the inosine may be changed to a G irreversibly and permanently through cellular DNA repair processes, resulting in a permanent change from an A:T base pair to a G:C base pair.

Without wishing to be bound by any particular theory, the adenosine nucleobase editors described herein work by using ecTadA variants to deaminate A bases in DNA, causing A to G mutations via inosine formation. Inosine preferentially hydrogen bonds with C, resulting in A to G mutation during DNA replication. When covalently tethered to Cas9 (or another nucleic acid programmable DNA binding protein), the adenosine deaminase (e.g., ecTadA) is localized to a gene of interest and catalyzes A to G mutations in the ssDNA substrate. This editor can be used to target and revert single nucleotide polymorphisms (SNPs) in disease-relevant genes, which require A to G reversion. This editor can also be used to target and revert single nucleotide polymorphisms (SNPs) in disease-relevant genes, which require T to C reversion by mutating the A, opposite of the T, to a G. The T may then be replaced with a C, for example by base excision repair mechanisms, or may be changed in subsequent rounds of DNA replication.

Some aspects of the disclosure relate to the discovery that engineered (e.g., evolved) adenosine deaminases are capable of deaminating adenosine in a deoxyribonucleic acid (DNA) substrate. In some embodiments, the disclosure provides such adenosine deaminases. In some embodiments, the adenosine deaminases provided herein are capable of deaminating an adenosine in a DNA molecule. Other aspects of the disclosure provide fusion proteins comprising a Cas9 domain and an adenosine deaminase domain, for example, an engineered deaminase domain capable of deaminating an adenosine in DNA. In some embodiments, the fusion protein comprises one or more of a nuclear localization sequence (NLS), an inhibitor of inosine base excision repair (e.g., dISN), and/or a linker.

In some aspects, the disclosure provides an adenosine deaminase capable of deaminating an adenosine in a deoxyribonucleic acid (DNA) substrate. In some embodiments, the adenosine deaminase is from a bacterium, for example, *E. coli* or *S. aureus*. In some embodiments, the adenosine deaminase is a TadA deaminase. In some embodiments, the TadA deaminase is an *E. coli* TadA deaminase (ecTadA). In some embodiments, the adenosine deaminase comprises a D108X mutation in SEQ ID NO: 1, or a corresponding mutation in another adenosine deaminase, wherein X is any amino acid other than the amino acid found in the wild-type protein. In some embodiments, X is G, N, V, A, or Y.

In some embodiments, the adenosine deaminase comprises a E155X mutation in SEQ ID NO: 1, or a corresponding mutation in another adenosine deaminase, wherein X is any amino acid other than the amino acid found in the wild-type protein. In some embodiments, X is D, G, or V. It should be appreciated that the adenosine deaminases provided herein may contain one or more of the mutations provided herein in any combination.

Some aspects of the disclosure provide a fusion protein comprising: (i) a Cas9 domain, and (ii) an adenosine deaminase, such as any of the adenosine deaminases provided herein. In some embodiments, the Cas9 domain of the fusion protein is a nuclease dead Cas9 (dCas9), a Cas9 nickase (nCas9), or a nuclease active Cas9. In some embodiments, the fusion protein further comprises an inhibitor of inosine base excision repair, for example a dISN or a single stranded DNA binding protein. In some embodiments, the fusion protein comprises one or more linkers used to attach an adenine deaminase (e.g., ecTadA) to a nucleic acid programmable DNA binding protein (e.g., Cas9). In some embodiments, the fusion protein comprises one or more nuclear localization sequences (NLS).

The summary above is meant to illustrate, in a non-limiting manner, some of the embodiments, advantages, features, and uses of the technology disclosed herein. Other embodiments, advantages, features, and uses of the technology disclosed herein will be apparent from the Detailed Description, the Drawings, the Examples, and the Claims.

BRIEF DESCRIPTION OF THE DRAWINGS

FIG. 12 shows the colony forming units (C.F.U.) of various constructs challenged on increasing concentrations of chloramphenicol. The construct numbers correspond to those listed in FIG. 11.

FIG. 15 is a schematic showing the development of ABE.

FIG. 16 is a table showing the results of clones assayed after second round evolution. Columns 1, 8, and 10 represent mutations from the first round evolution. Columns 11 and 14 represent the consensus mutations from second round evolution.

Figure 21:
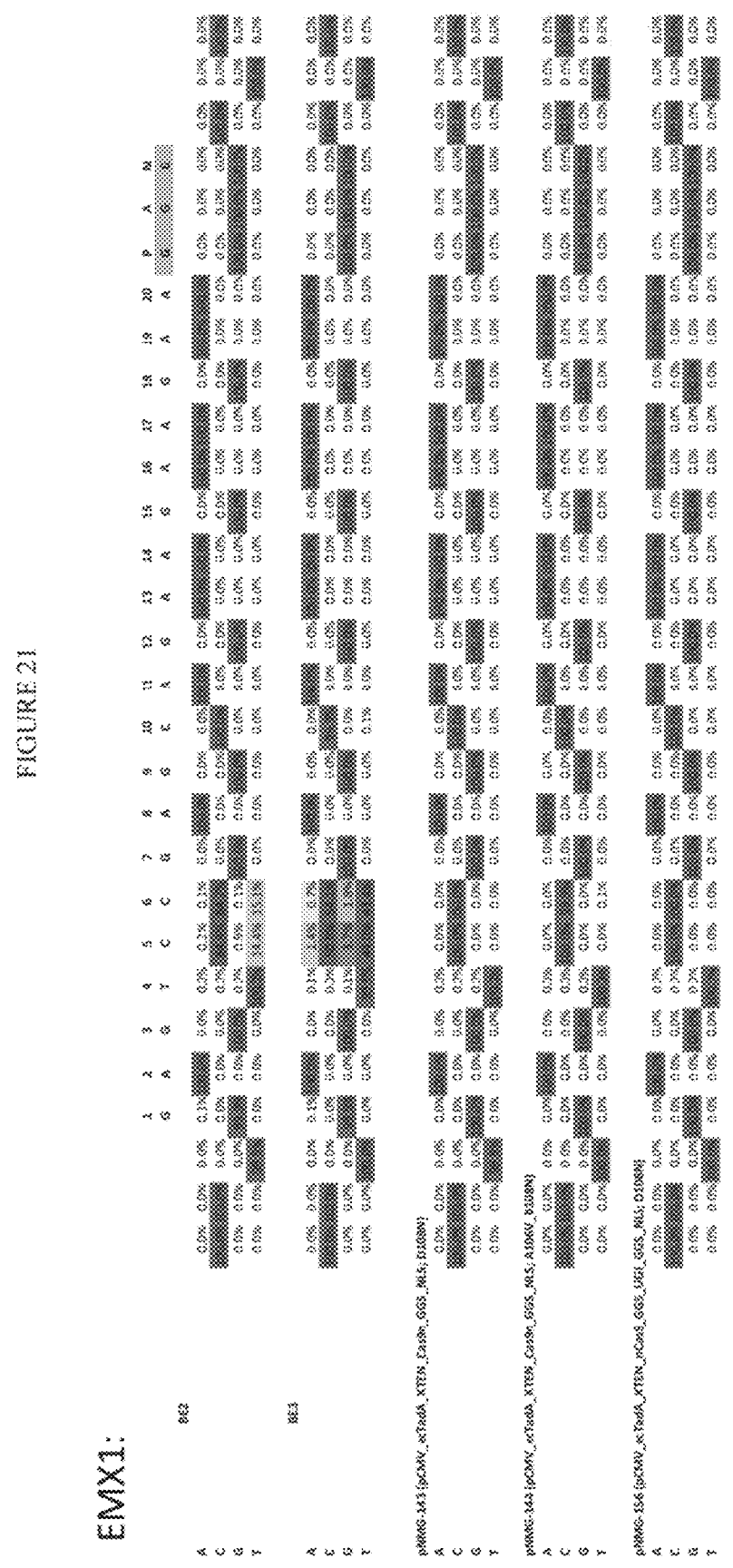

FIG. 21 shows that ABE operates best on 1 of 6 genomic sites tested. The sequence corresponds to SEQ ID NO: 46.

FIG. 24 shows inactive C-terminal Cas9 fusions of ecTadA for pNMG-174 through pNMG-177. The sequence corresponds to SEQ ID NO: 41.

FIG. 25 shows the editing results from ecTadA nucleobase editors (pNMG-143, pNMG-144, pNMG-164, and pNMG-177). The sequence corresponds to SEQ ID NO: 41.

FIG. 26 shows the editing results from ecTadA nucleobase editors (pNMG-164, pNMG-177, pNMG-178, pNMG-179, and pNMG-180). The sequence corresponds to SEQ ID NO: 41.

FIG. 27 shows the results of editing at the Hek-3 site. The sequence corresponds to SEQ ID NO: 42.

Figure 28:
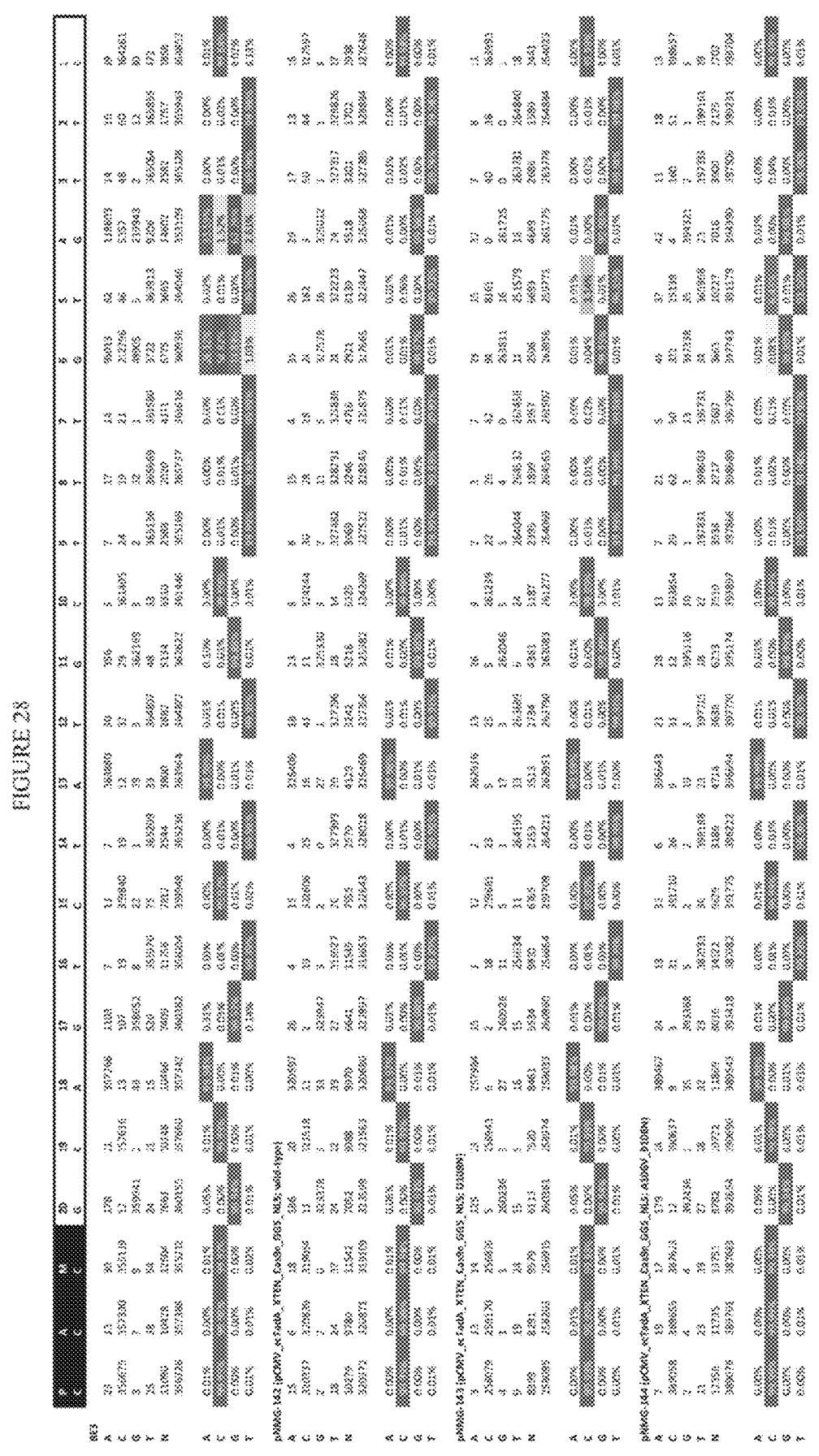
Figure 28:
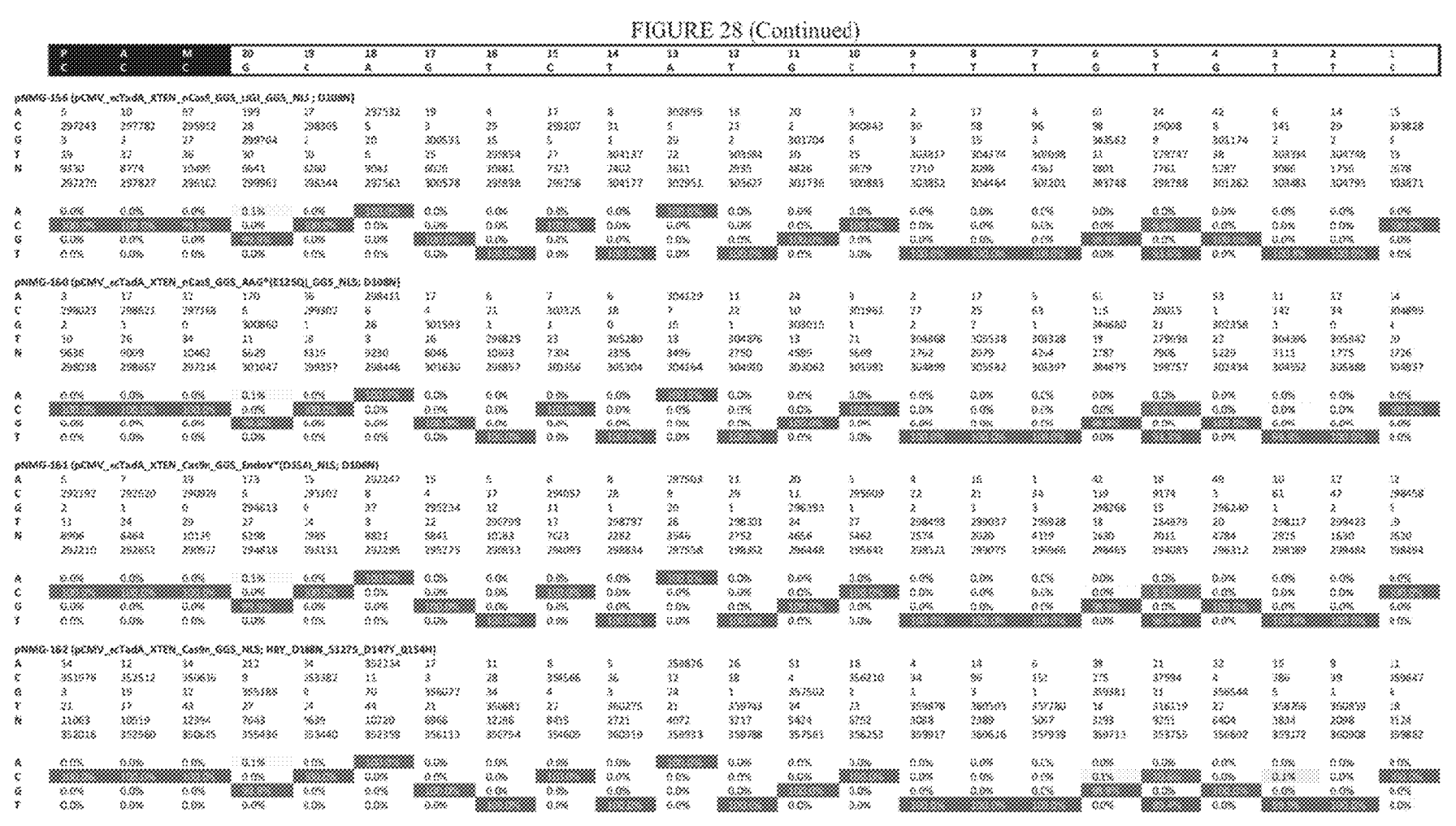
Figure 28:
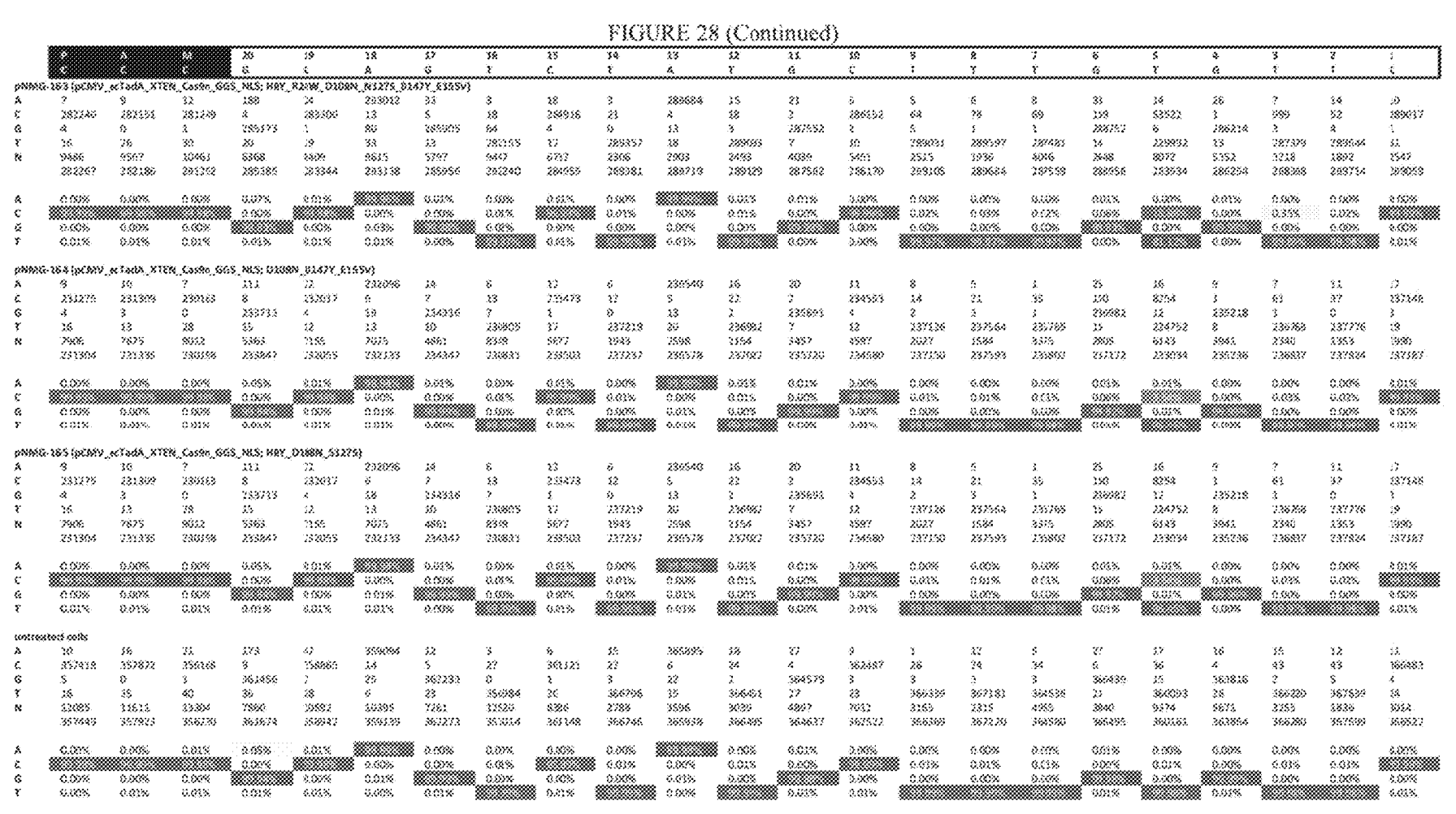

FIG. 28 shows the results of editing at the Hek-2 site. The sequence corresponds to SEQ ID NO: 41.

Figure 29:
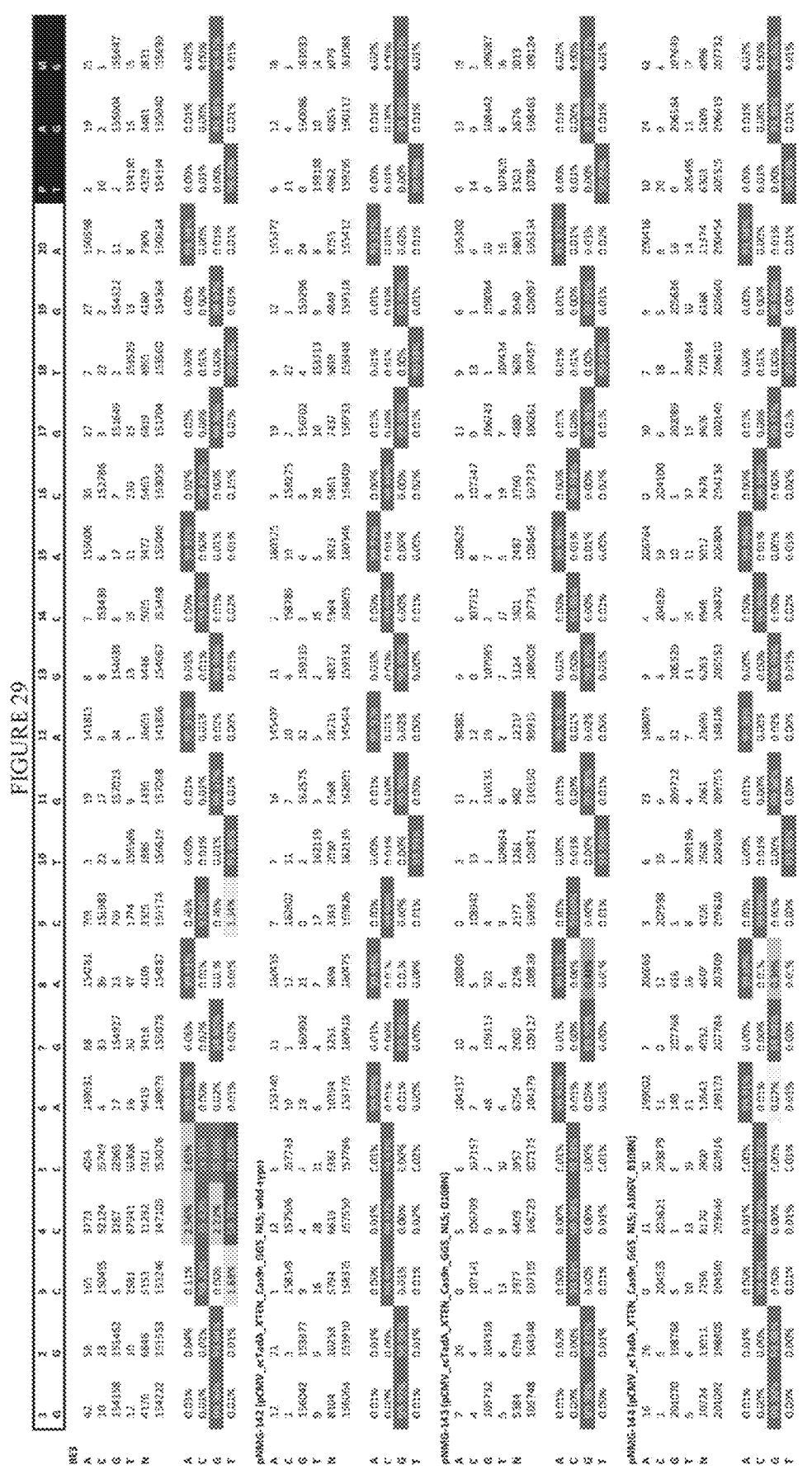
Figure 29:
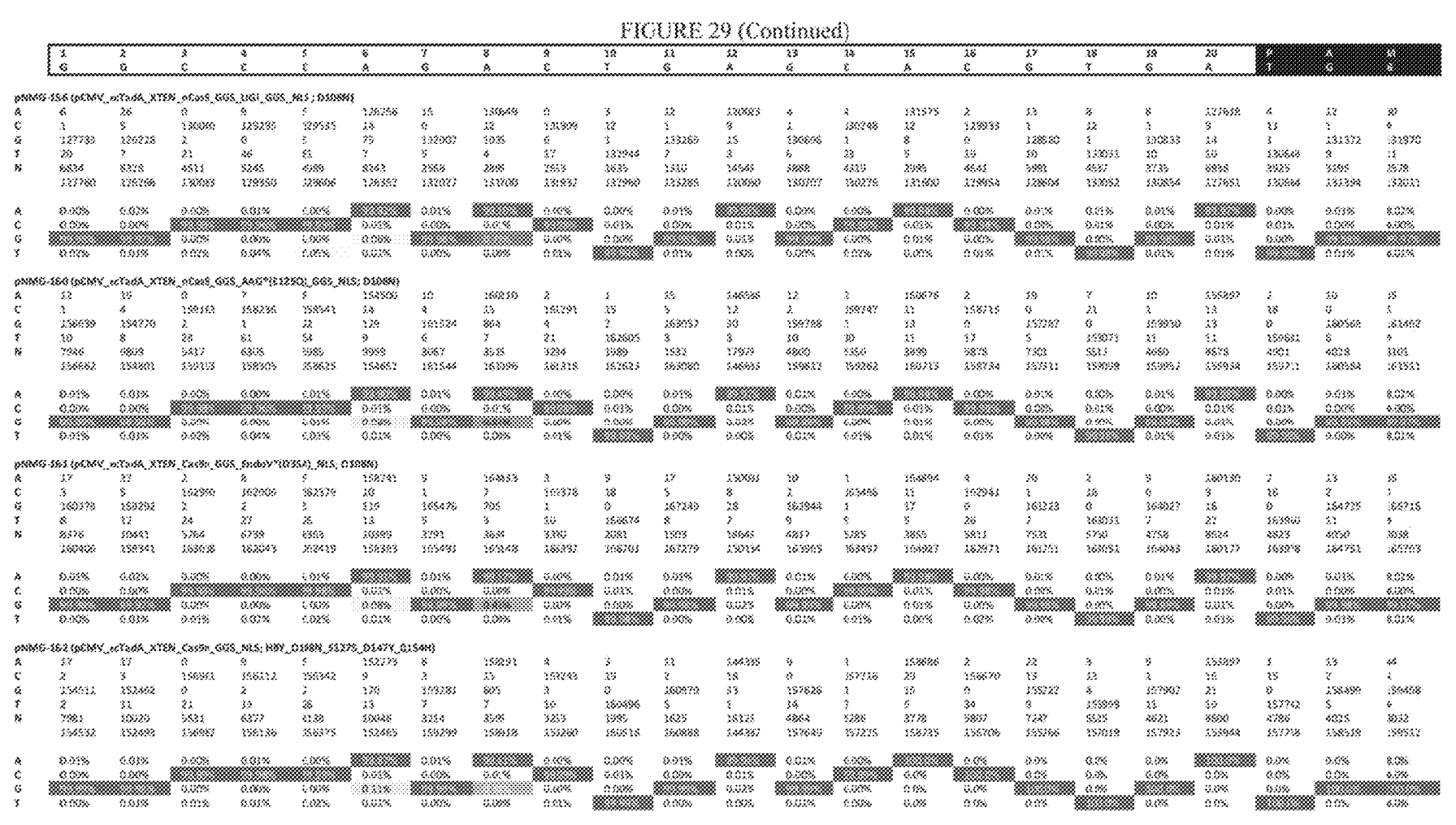
Figure 29:
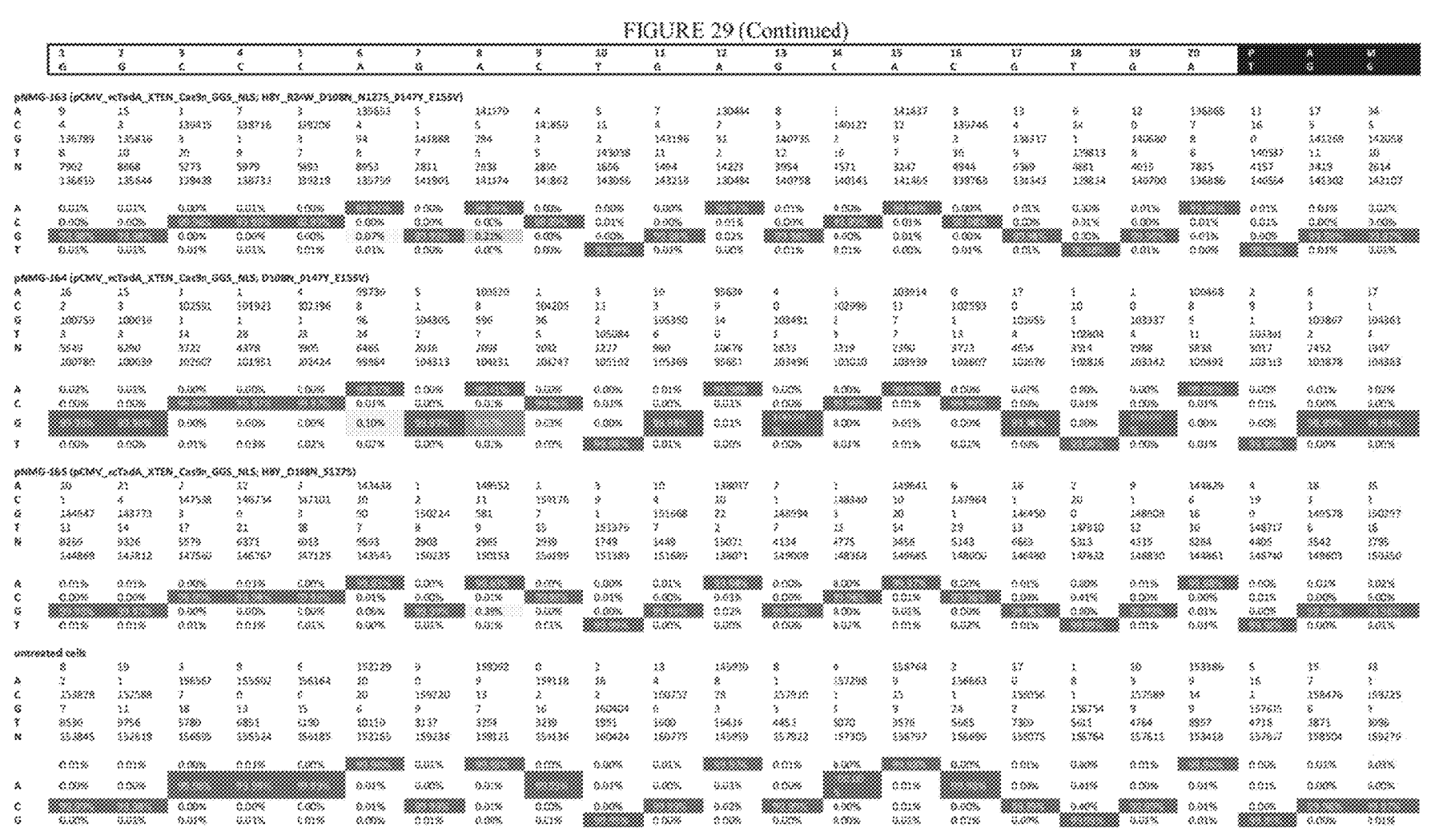

FIG. 29 shows the results of editing at the Hek-3 site. The sequence corresponds to SEQ ID NO: 42.

Figure 30:
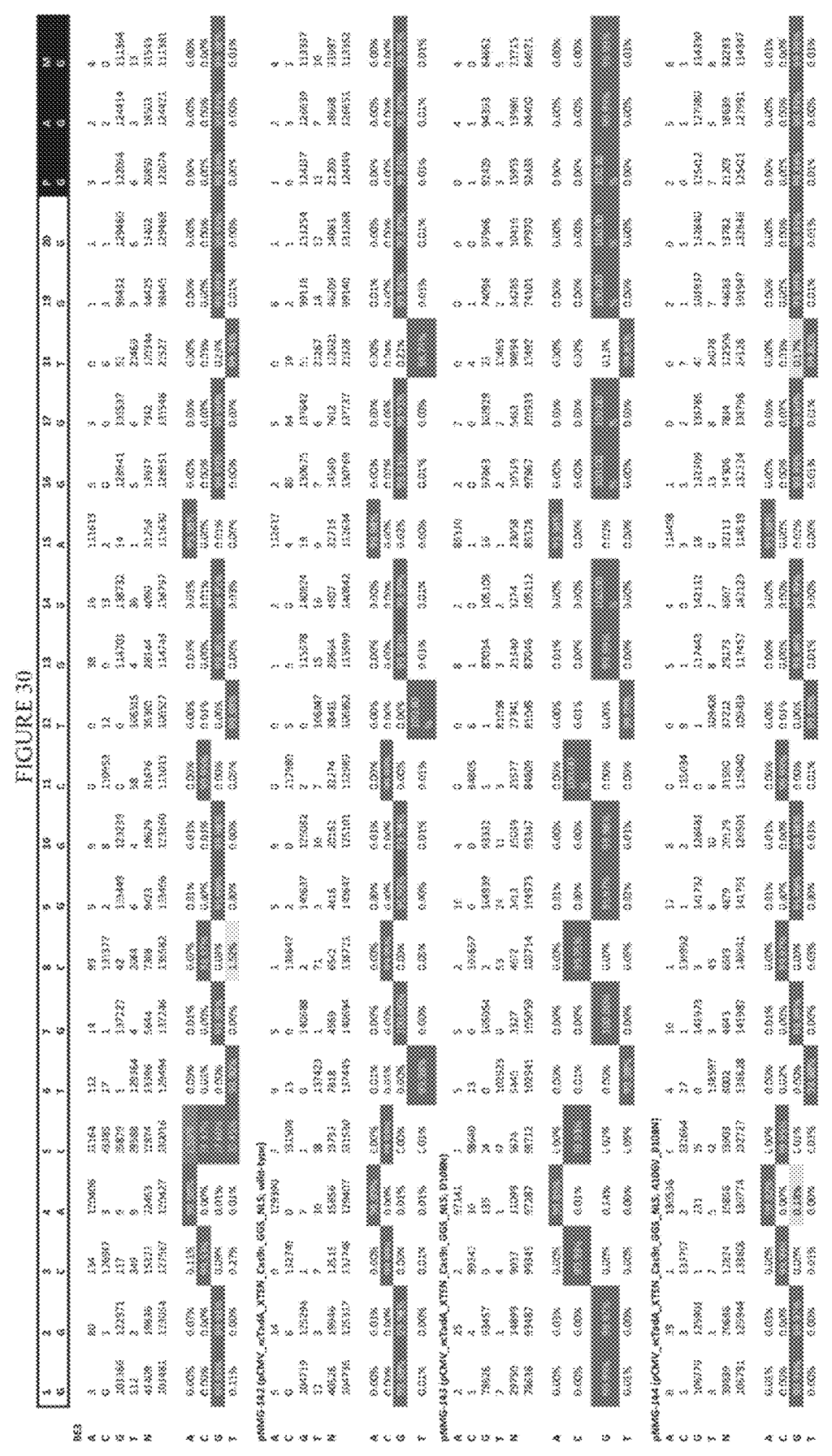
Figure 30:
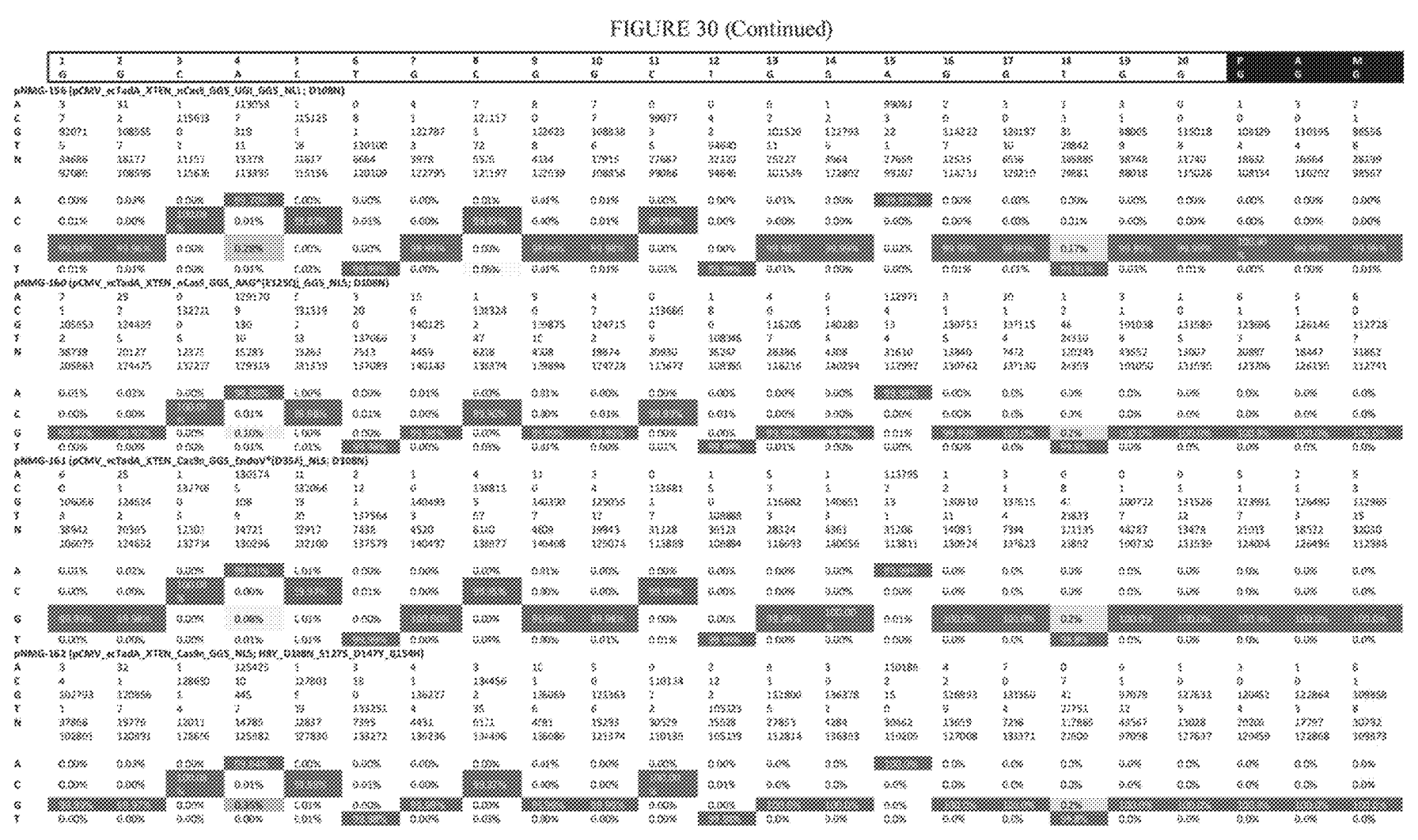
Figure 30:
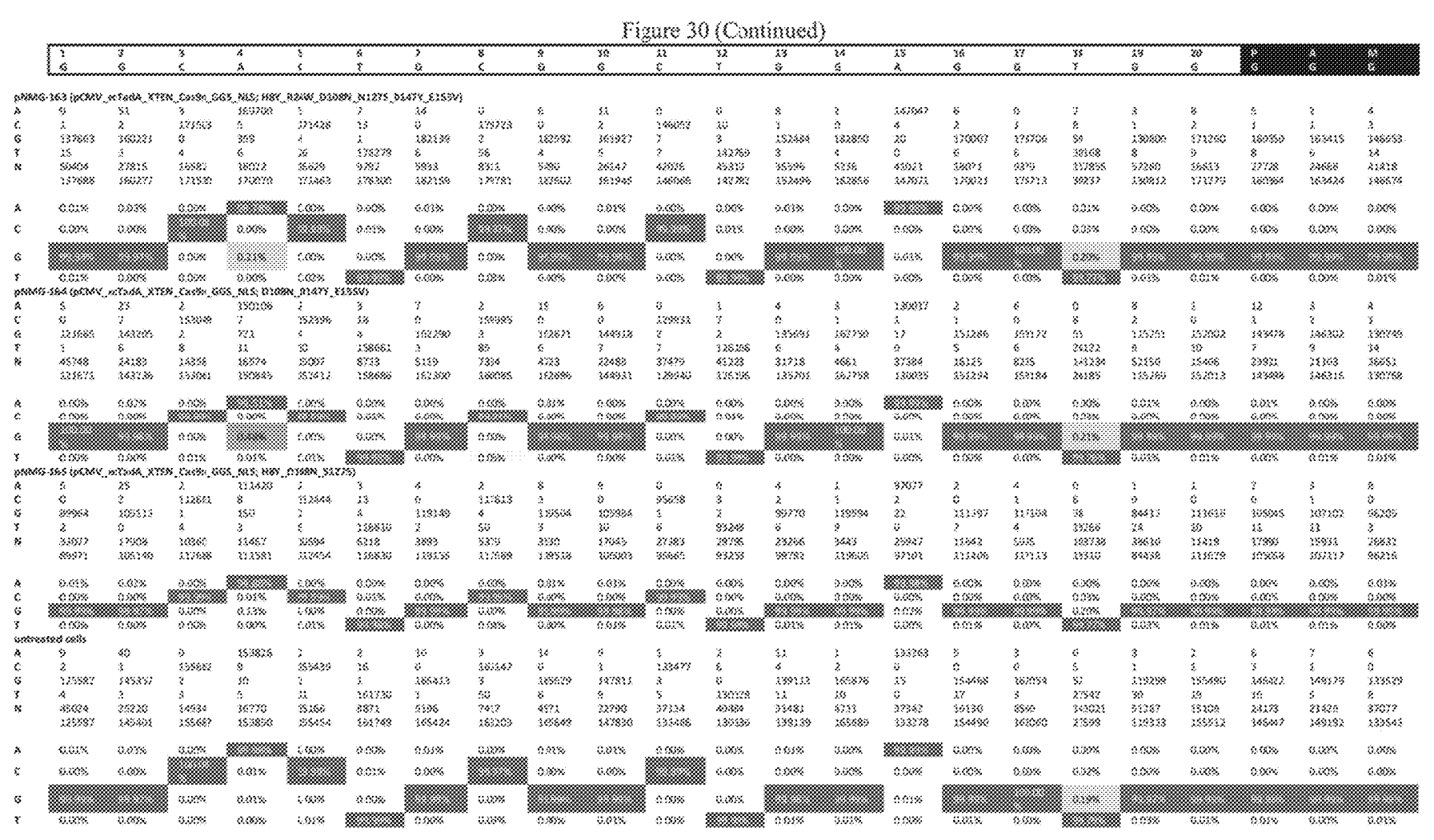

FIG. 30 shows the results of editing at the Hek-4 site. The sequence corresponds to SEQ ID NO: 43.

Figure 31:
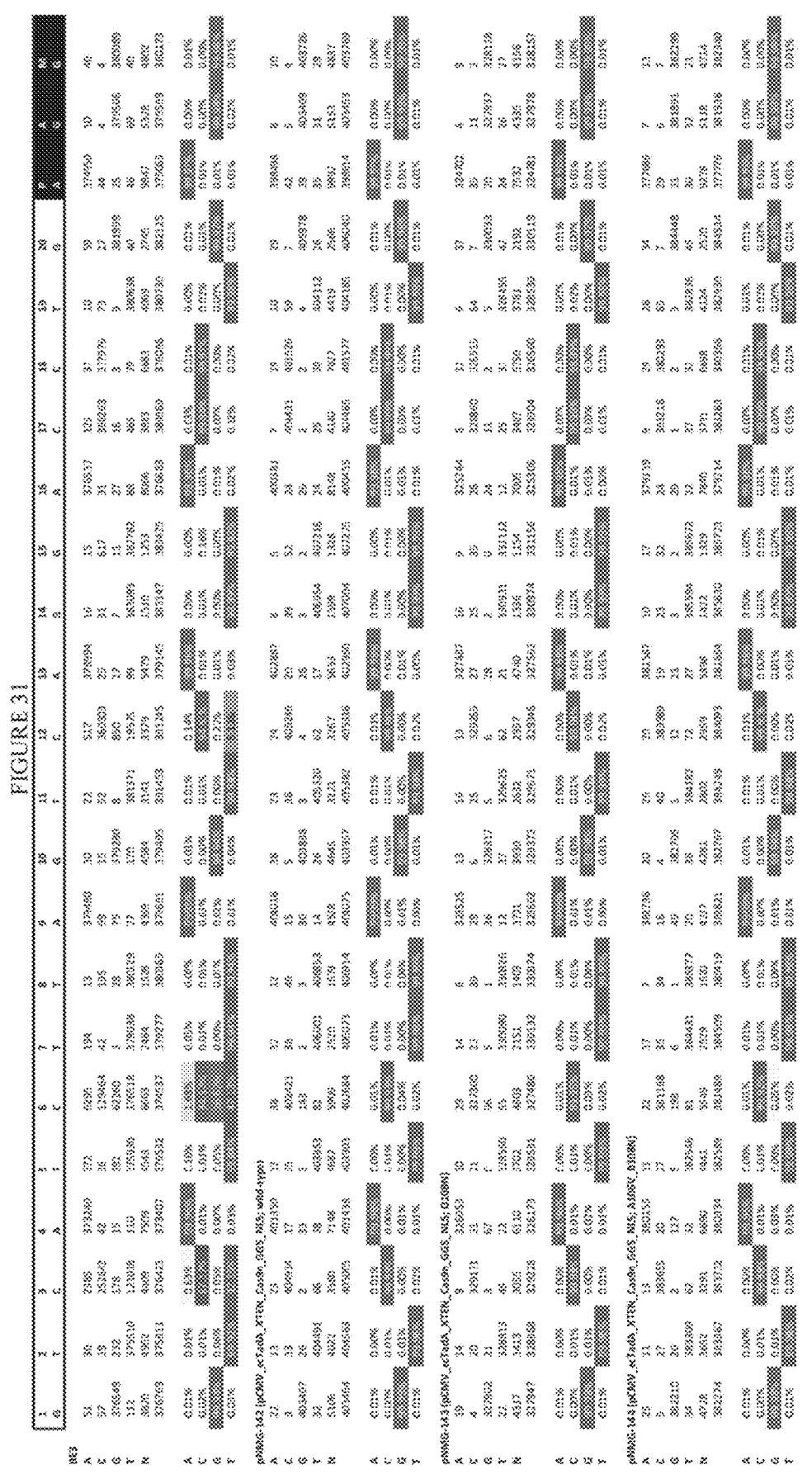
Figure 31:
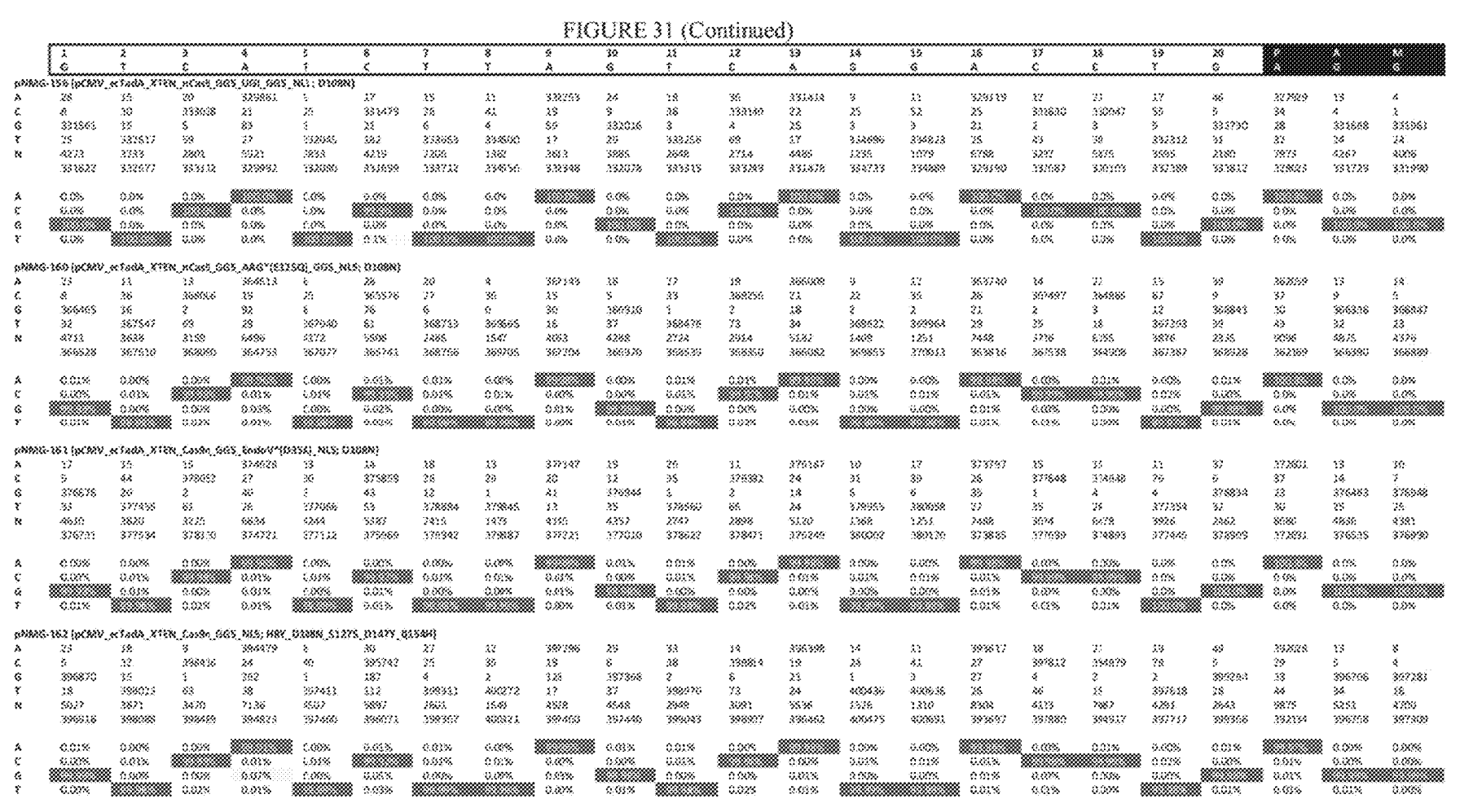
Figure 31:
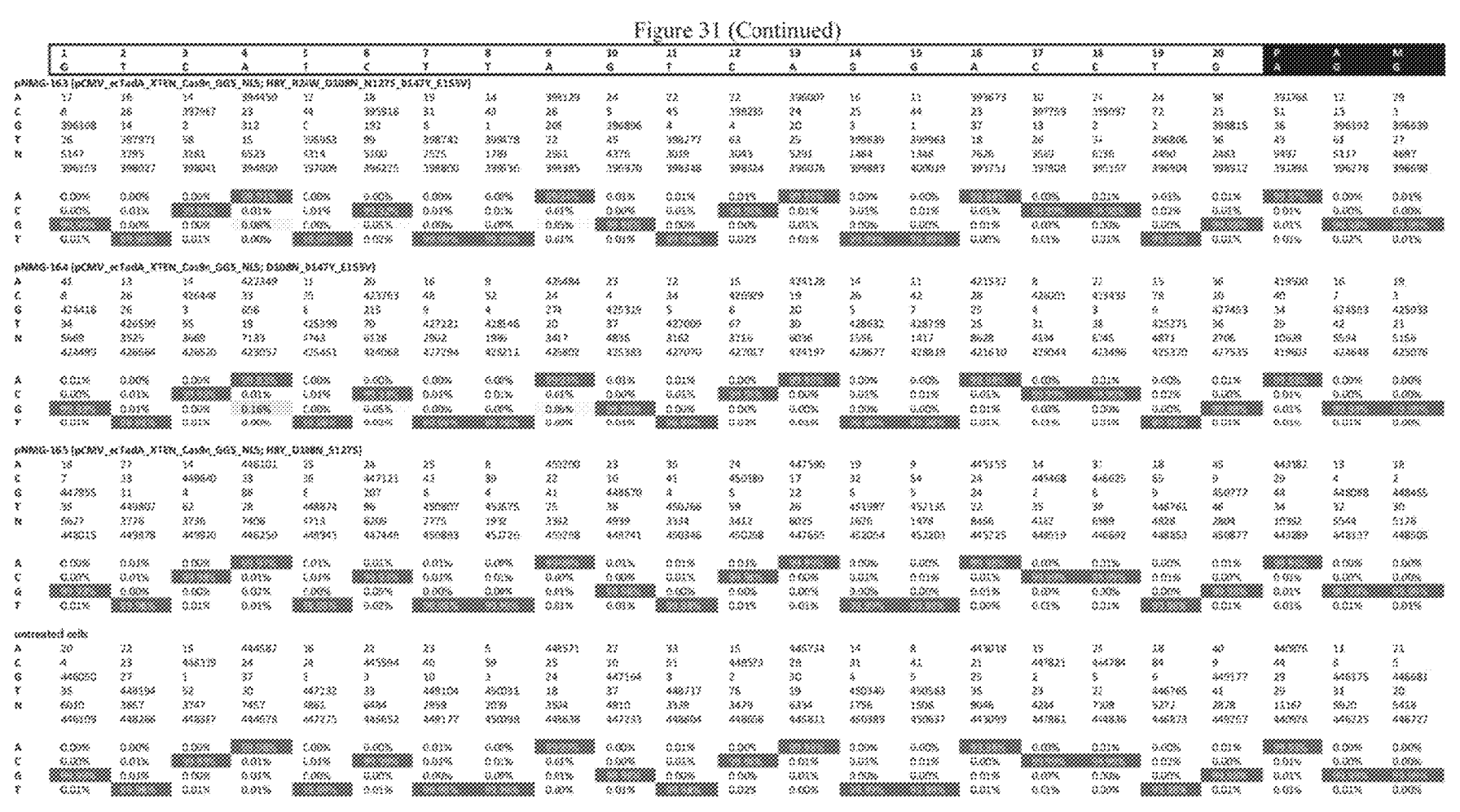

FIG. 31 shows the results of editing at the RNF-2 site. The sequence corresponds to SEQ ID NO: 44.

Figure 32:
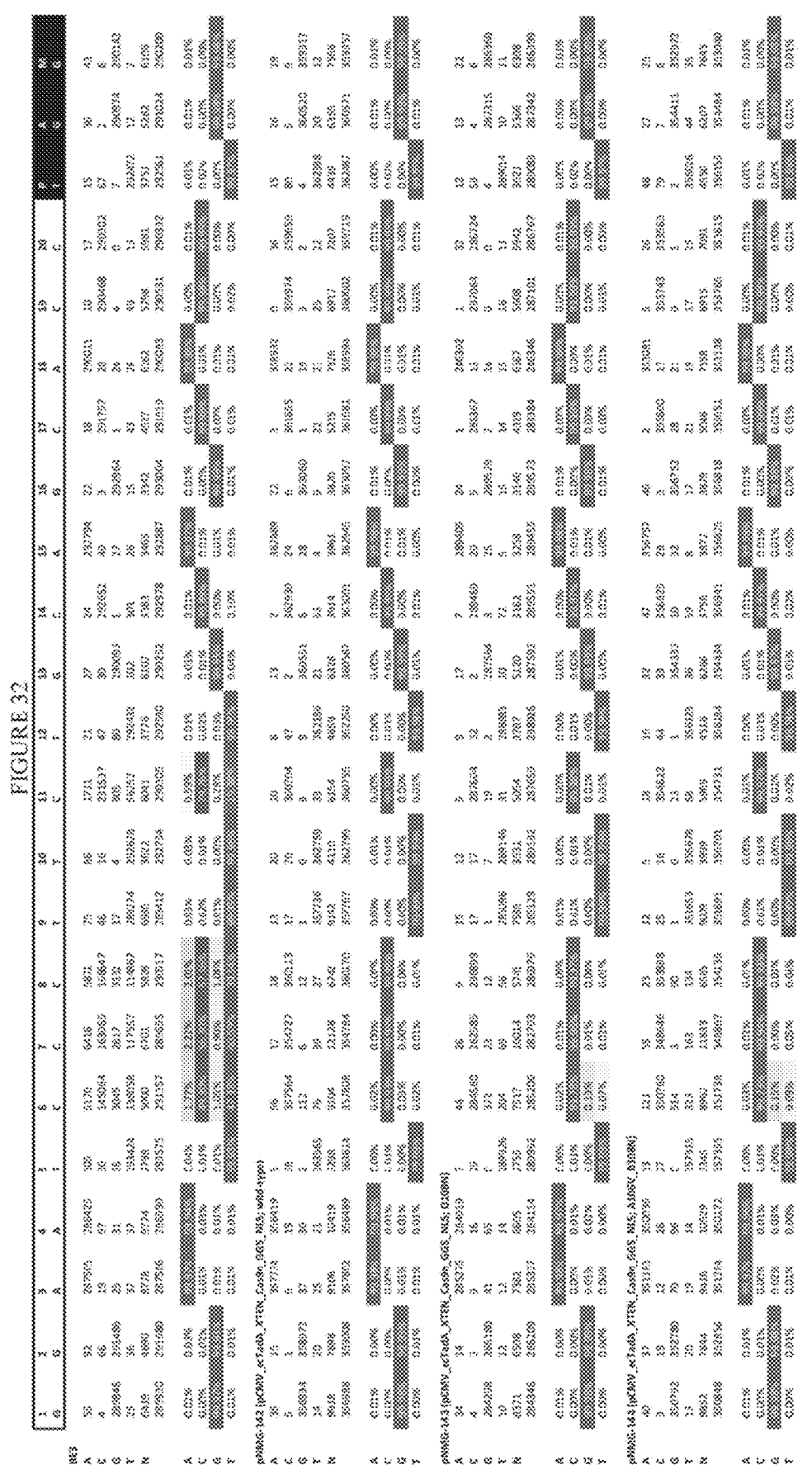
Figure 32:
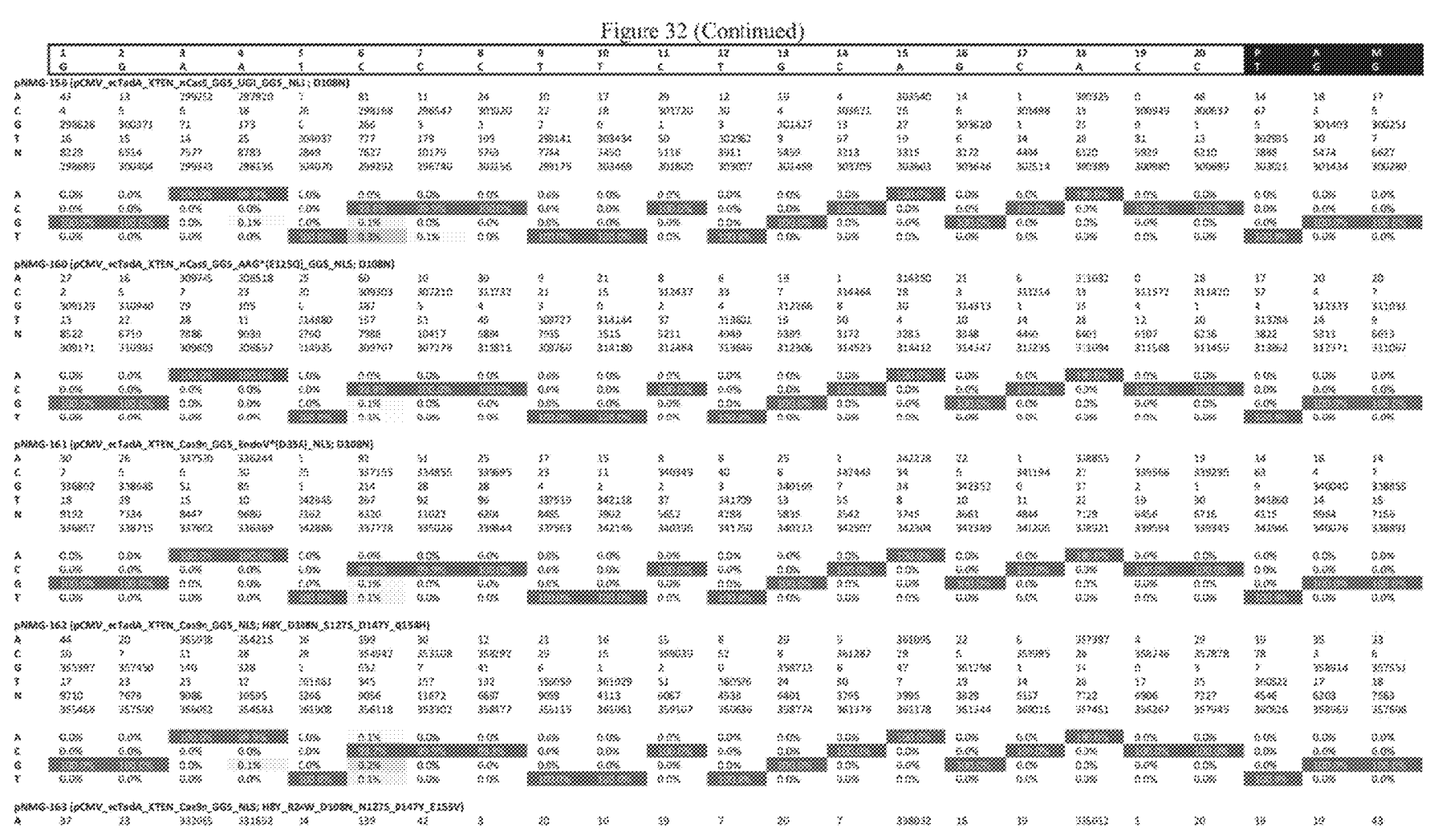
Figure 32:
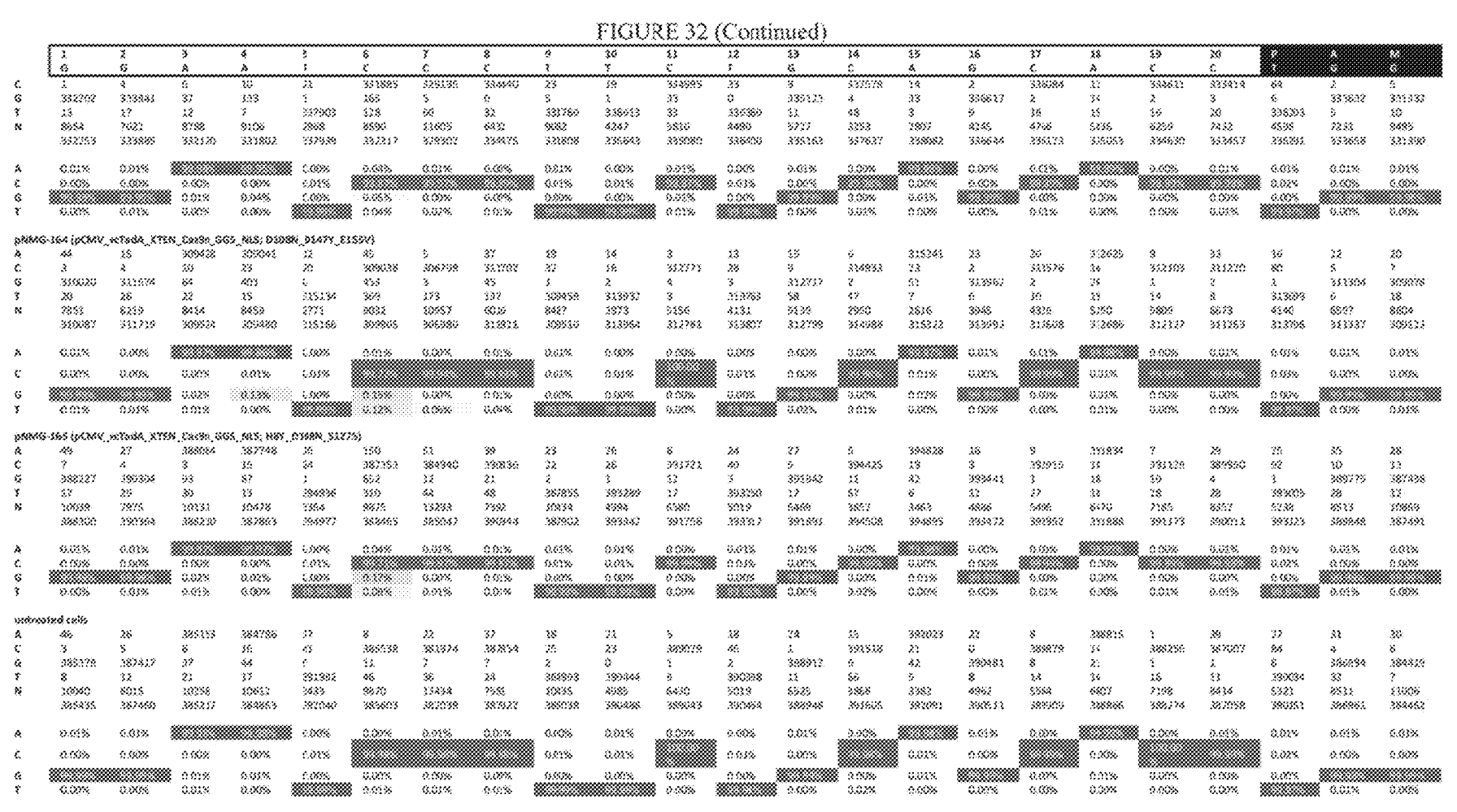

FIG. 32 shows the results of editing at the FANCF site. The sequence corresponds to SEQ ID NO: 45.

Figure 33:
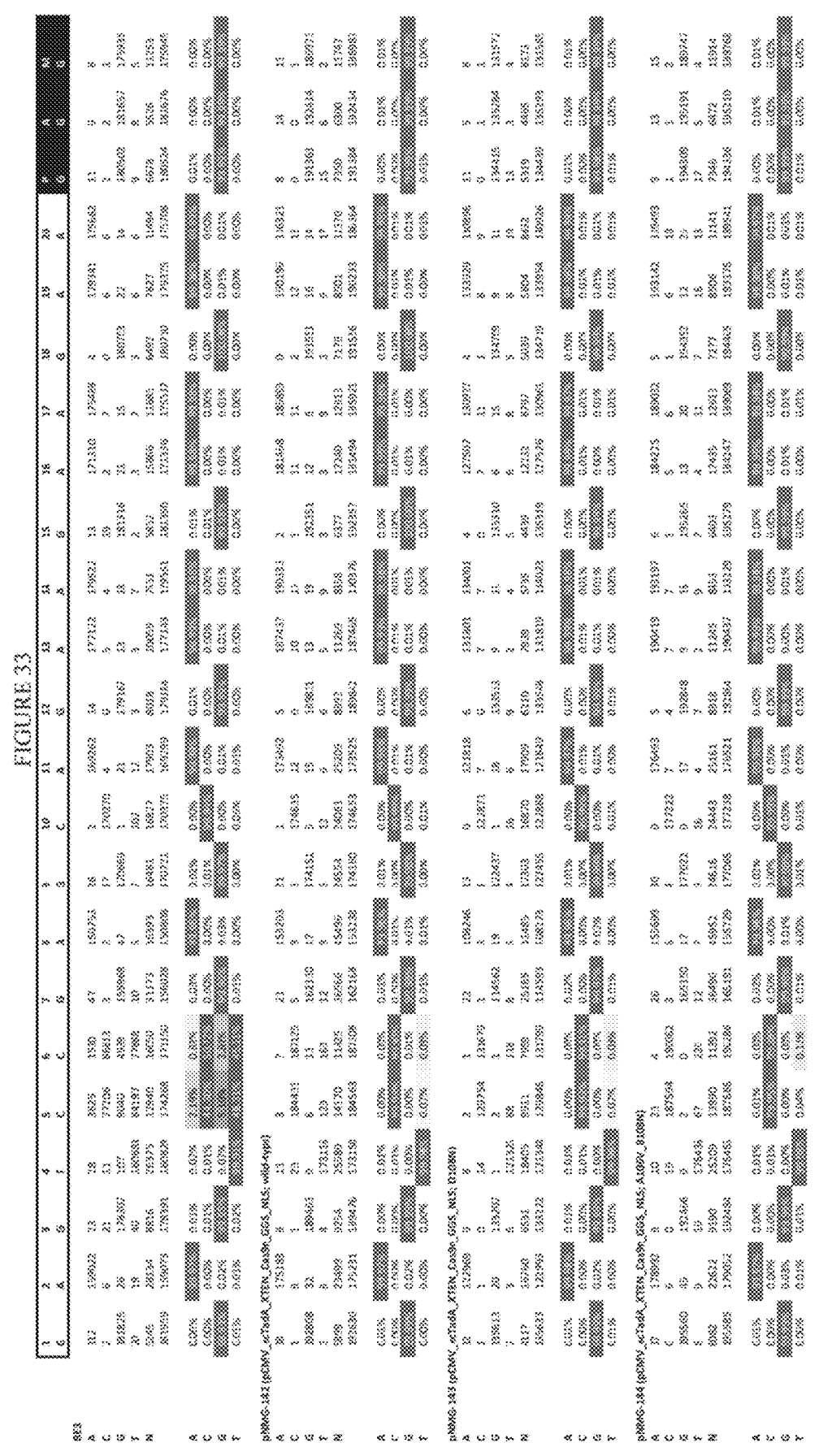
Figure 33:
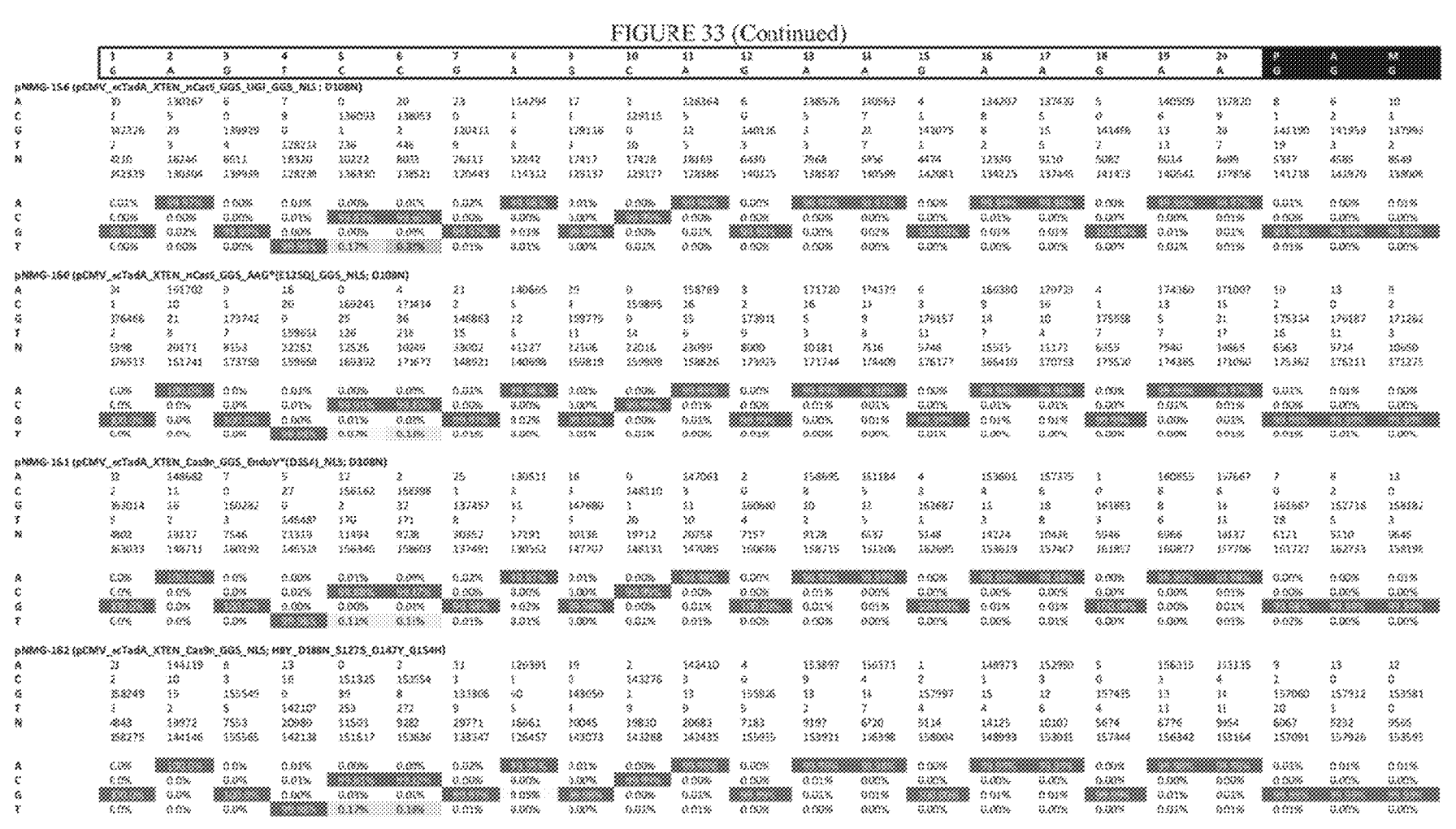
Figure 33:
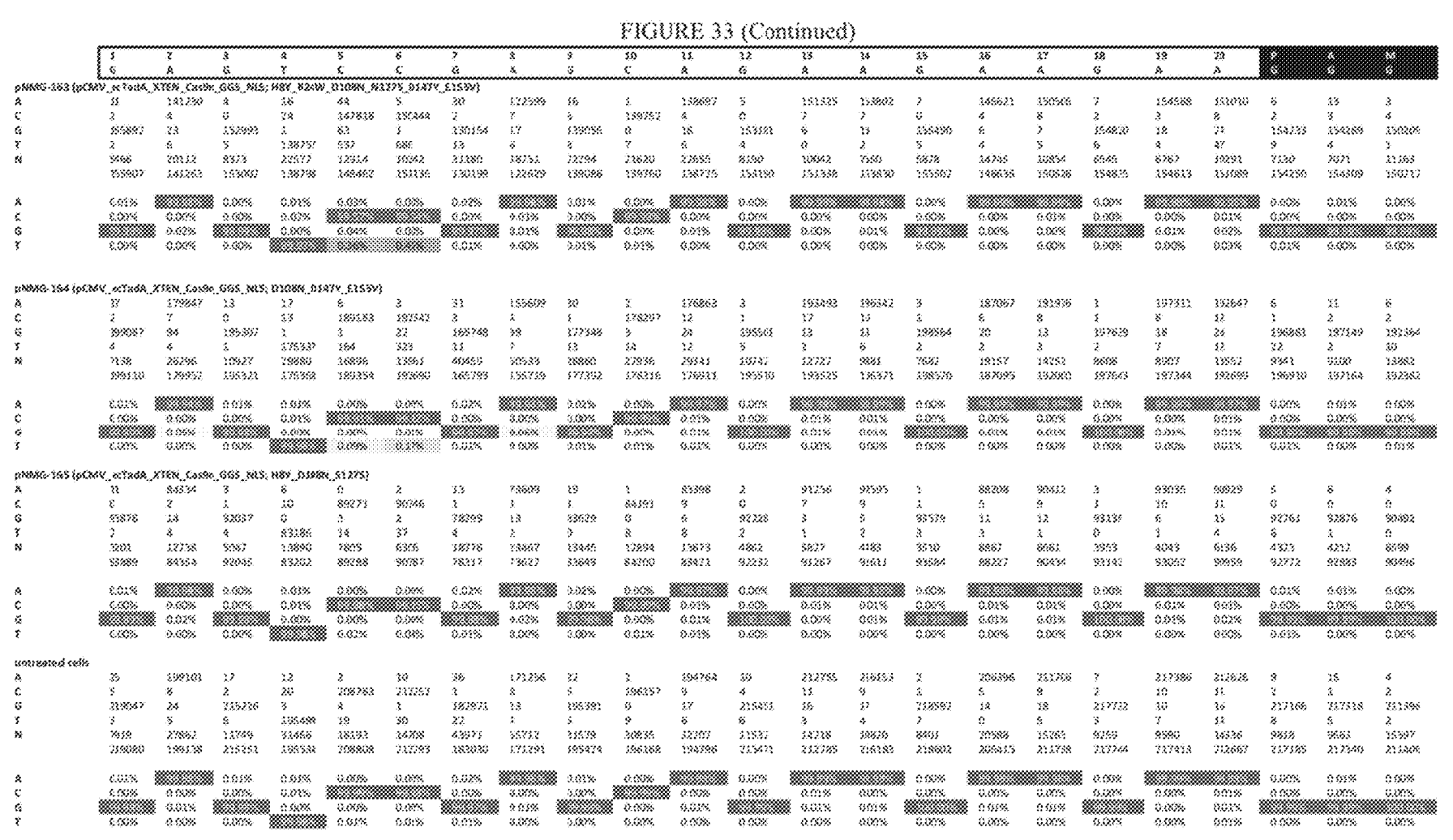

FIG. 33 shows the results of editing at the EMX-1 site. The sequence corresponds to SEQ ID NO: 46.

Figure 34:
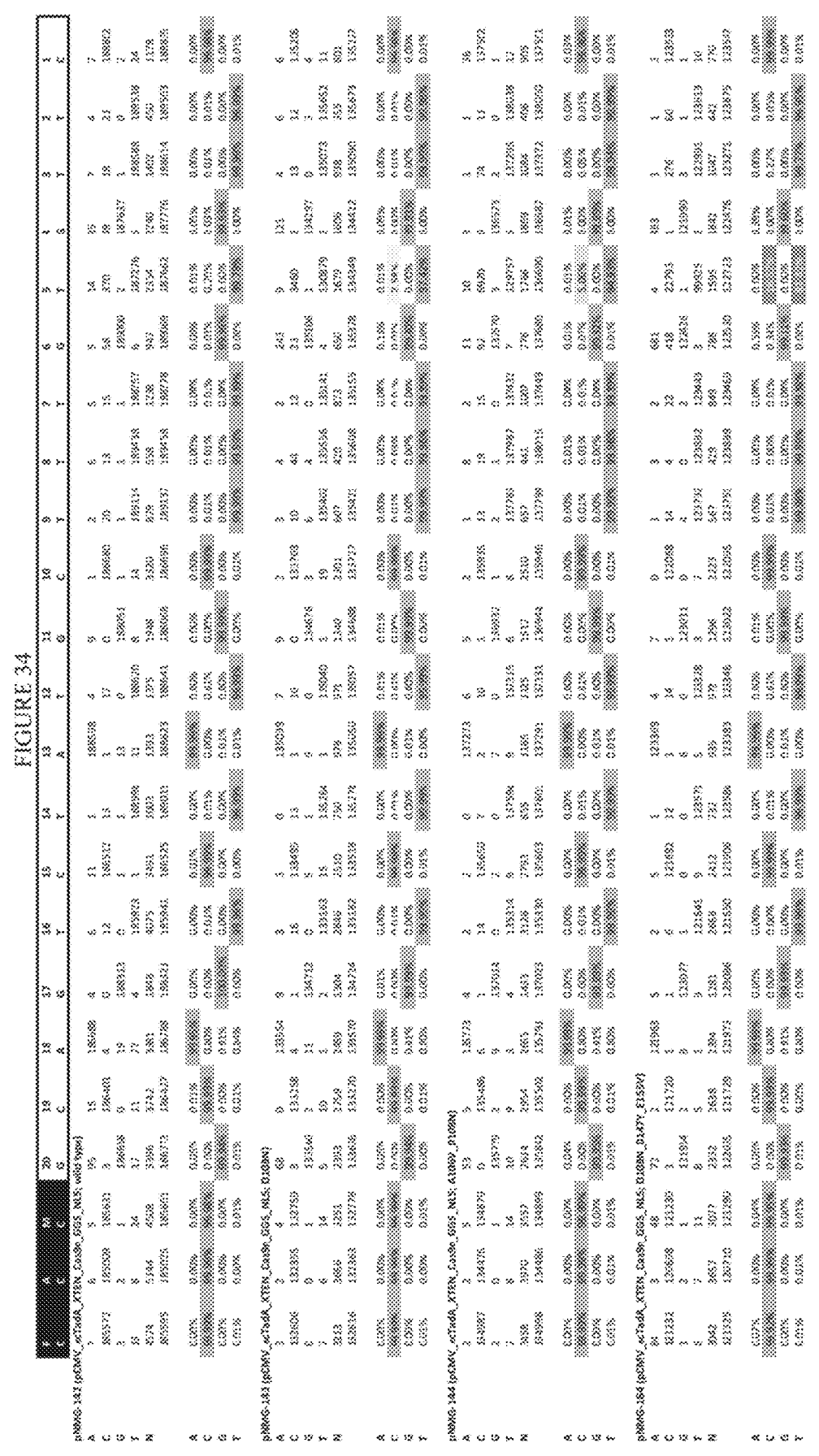
Figure 34:
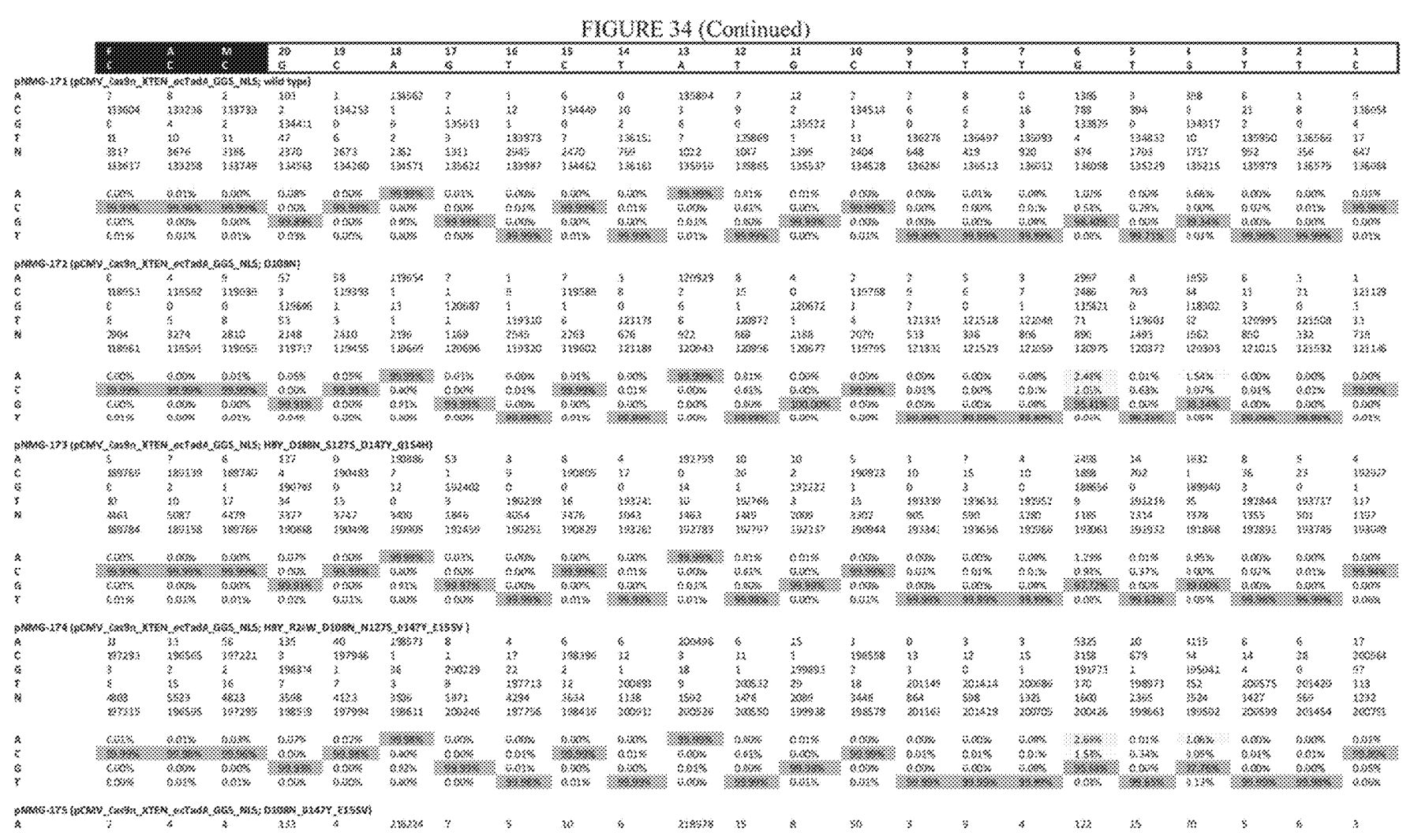
Figure 34:
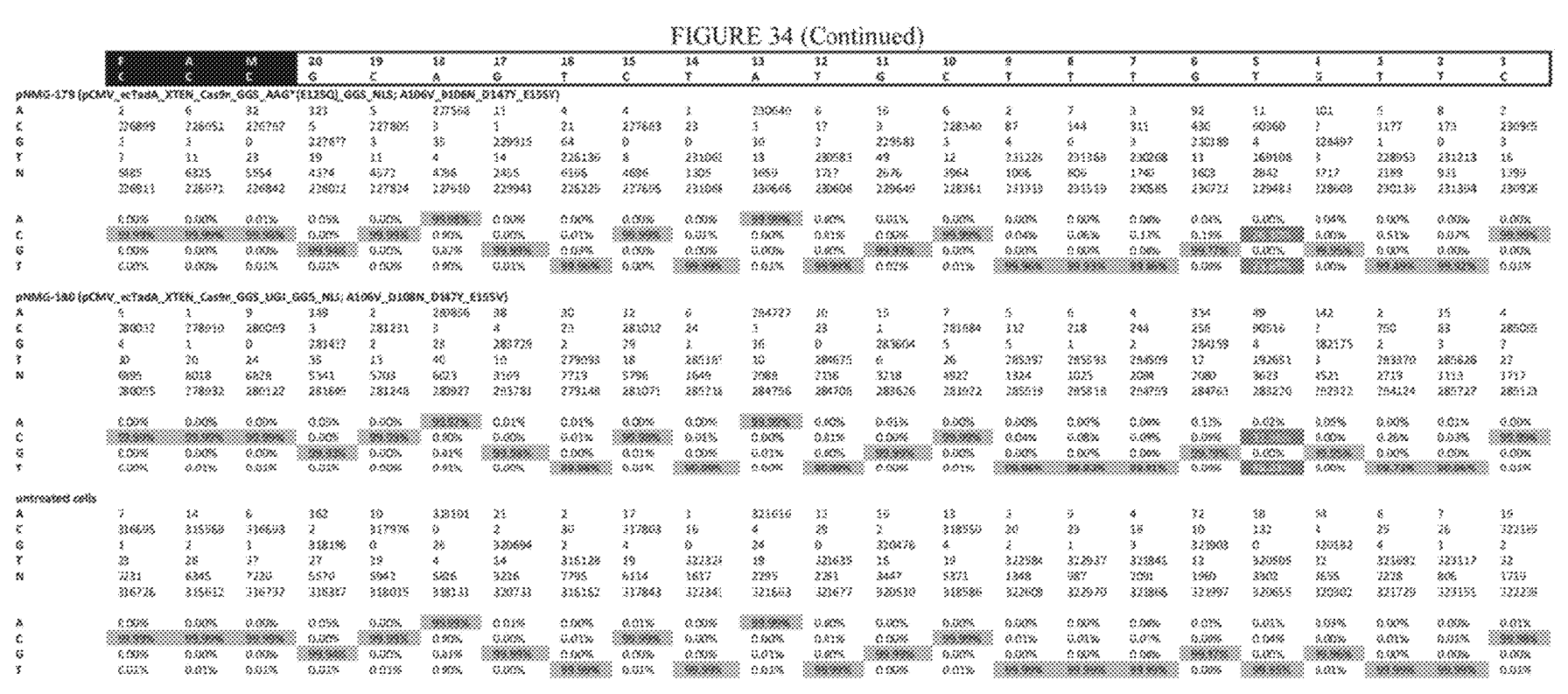

FIG. 34 shows the results of C-terminal fusion at the Hek-2 site. The sequence corresponds to SEQ ID NO: 41.

Figure 35:
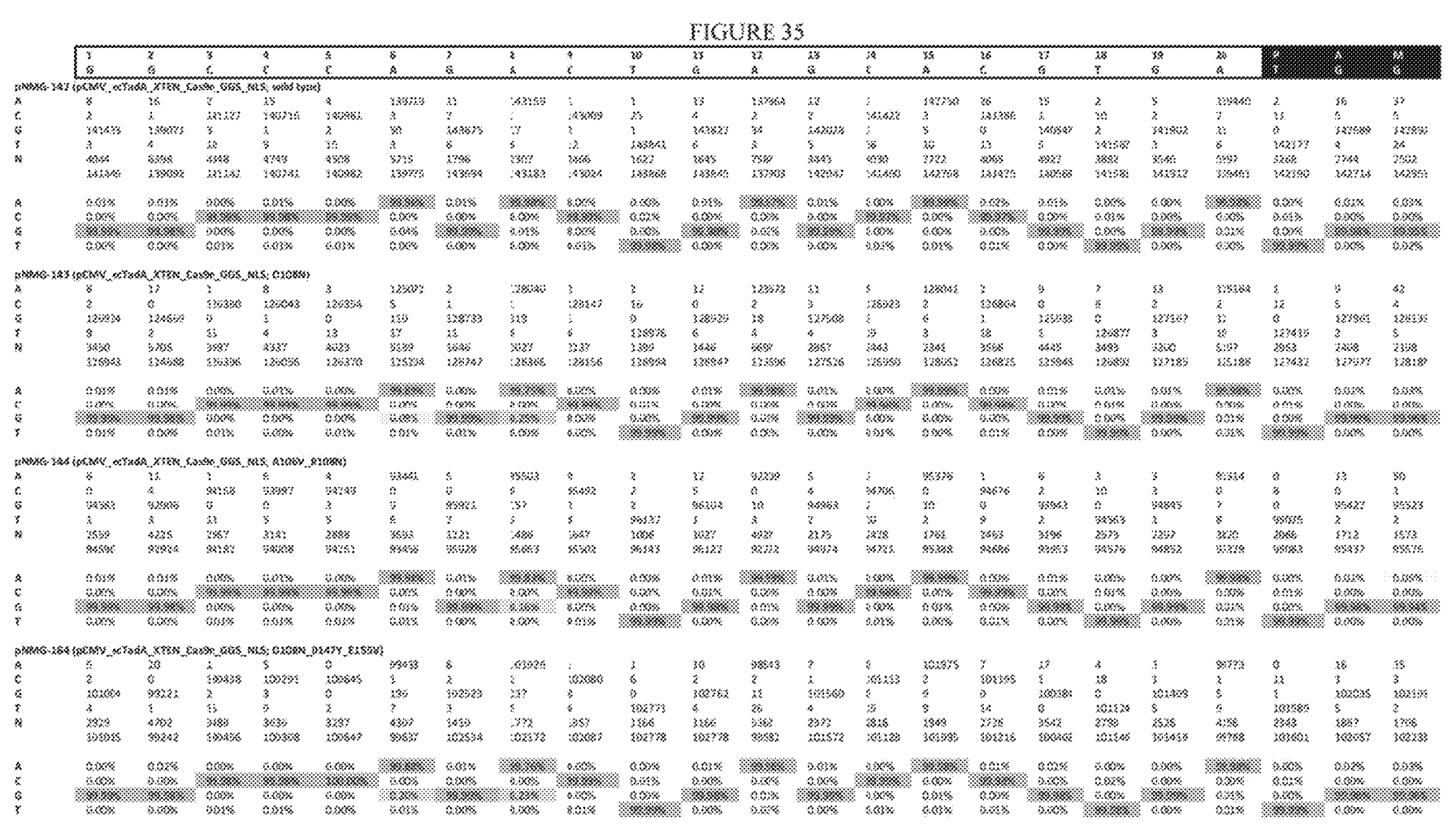
Figure 35:
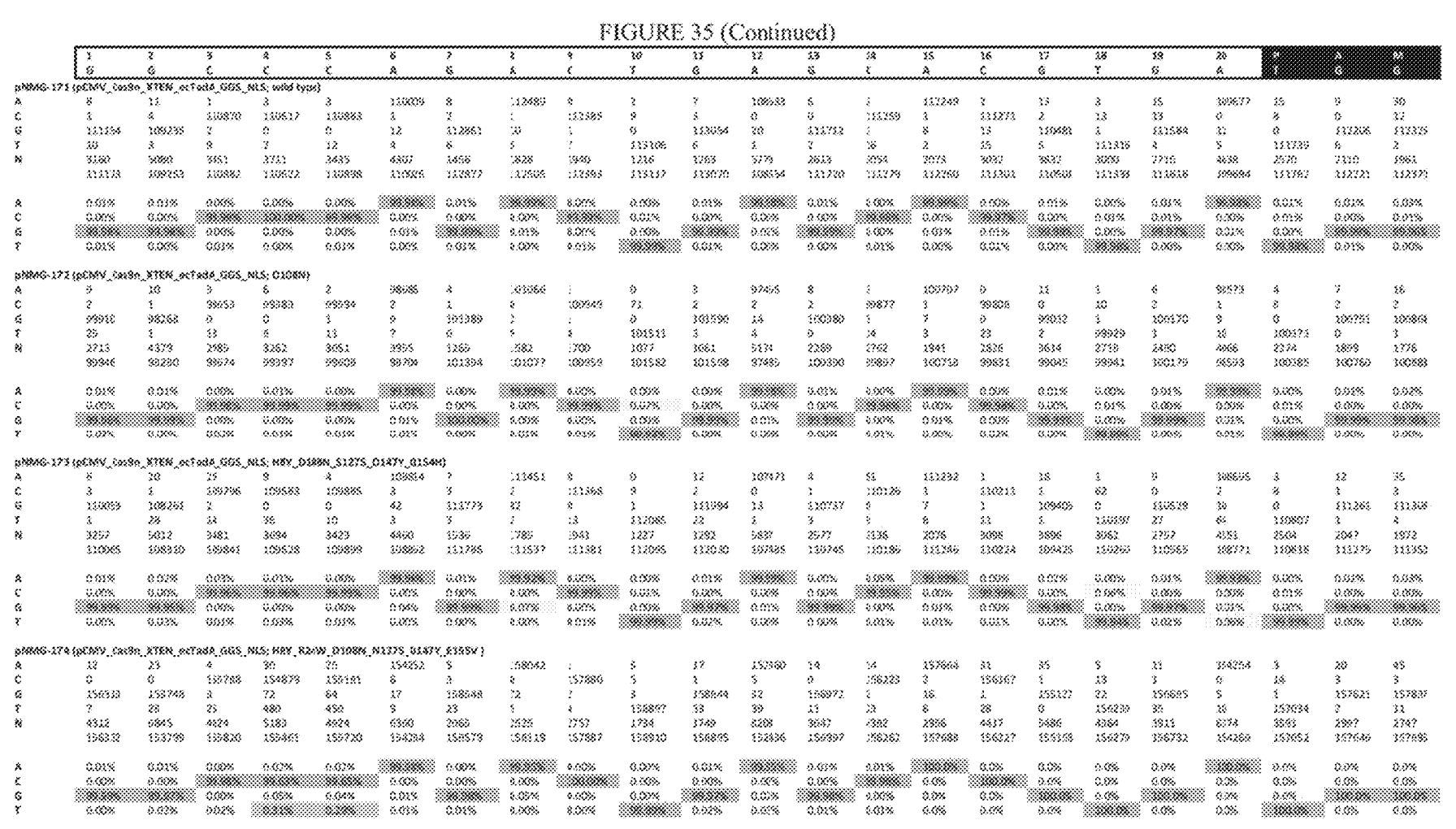
Figure 35:
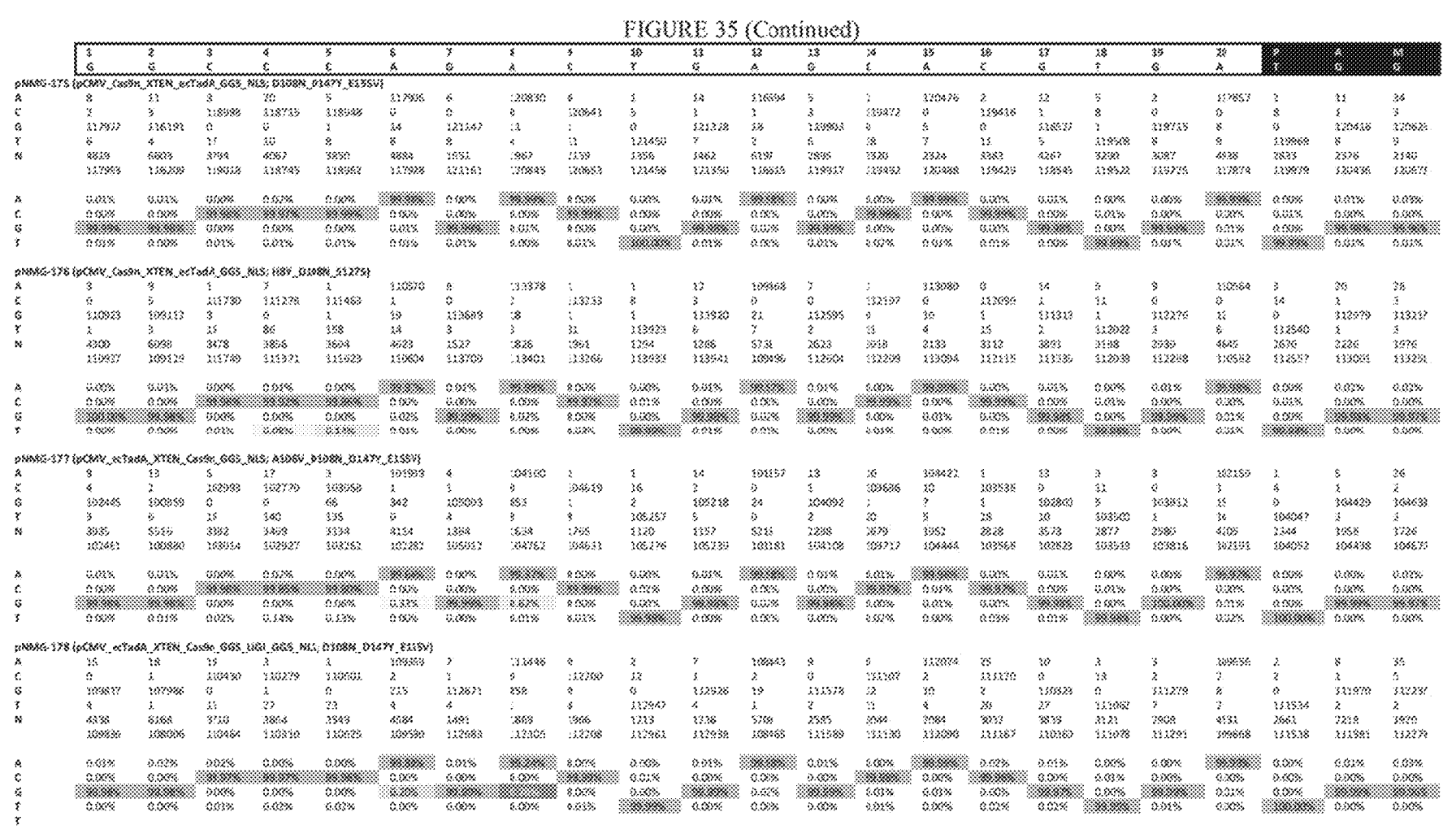
Figure 35:
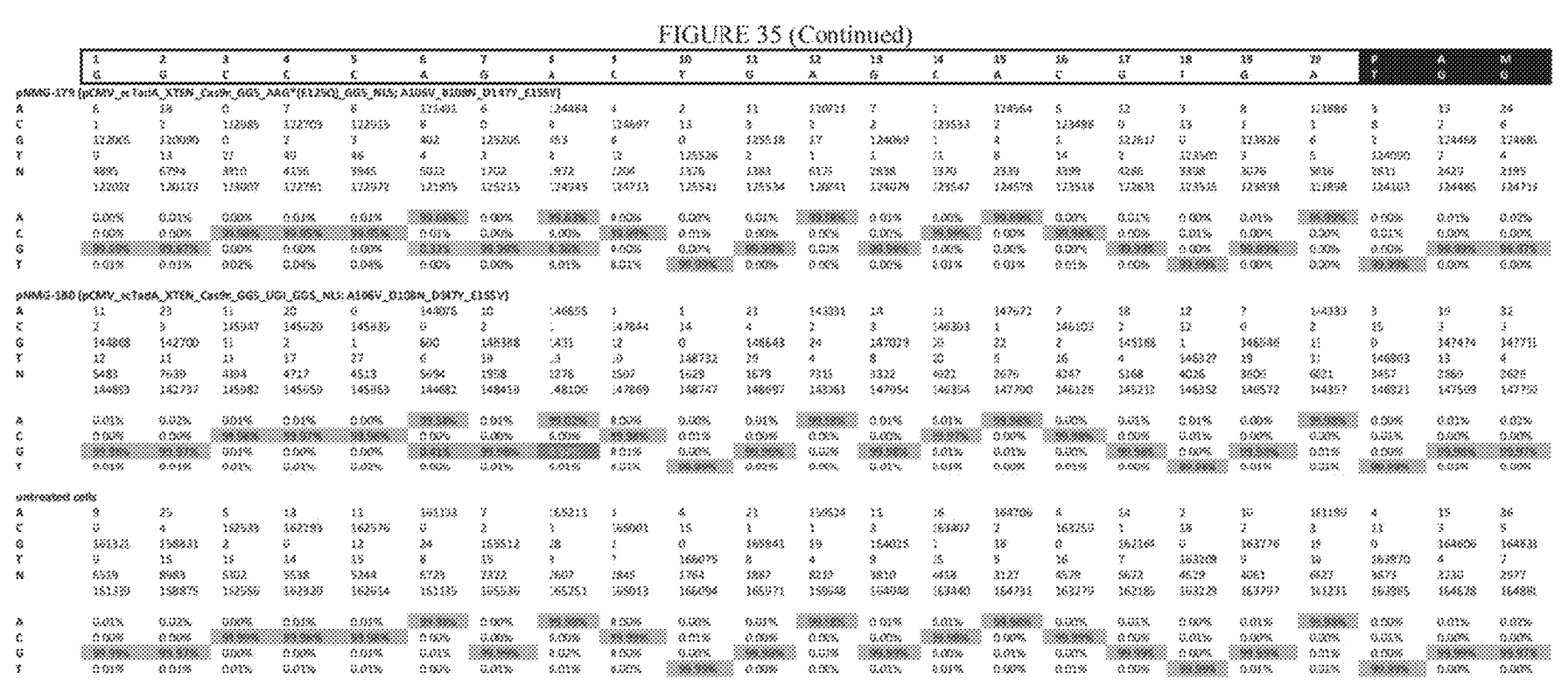

FIG. 35 shows the results of C-terminal fusion at the Hek-3 site. The sequence corresponds to SEQ ID NO: 42.

Figure 36:
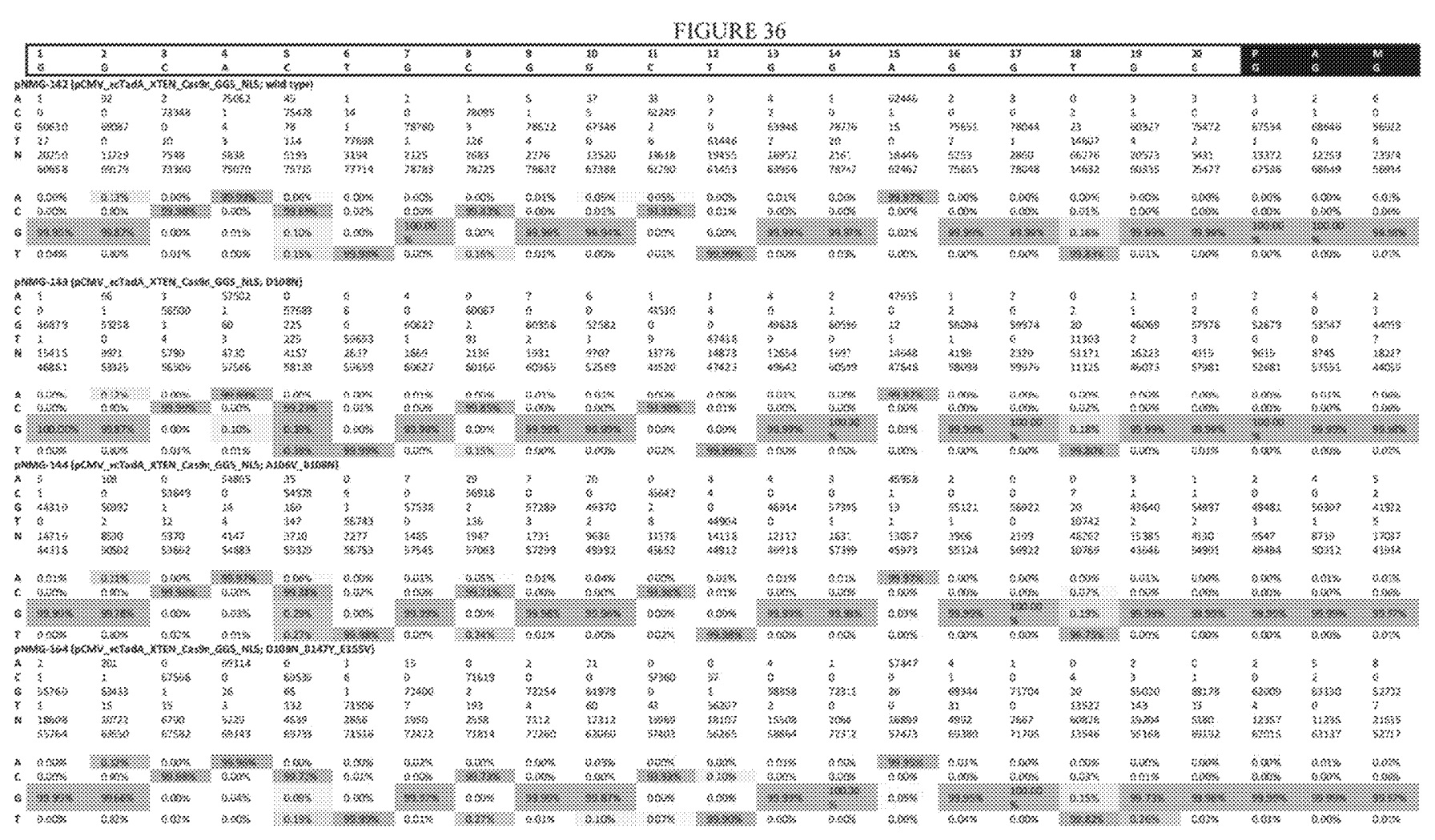
Figure 36:
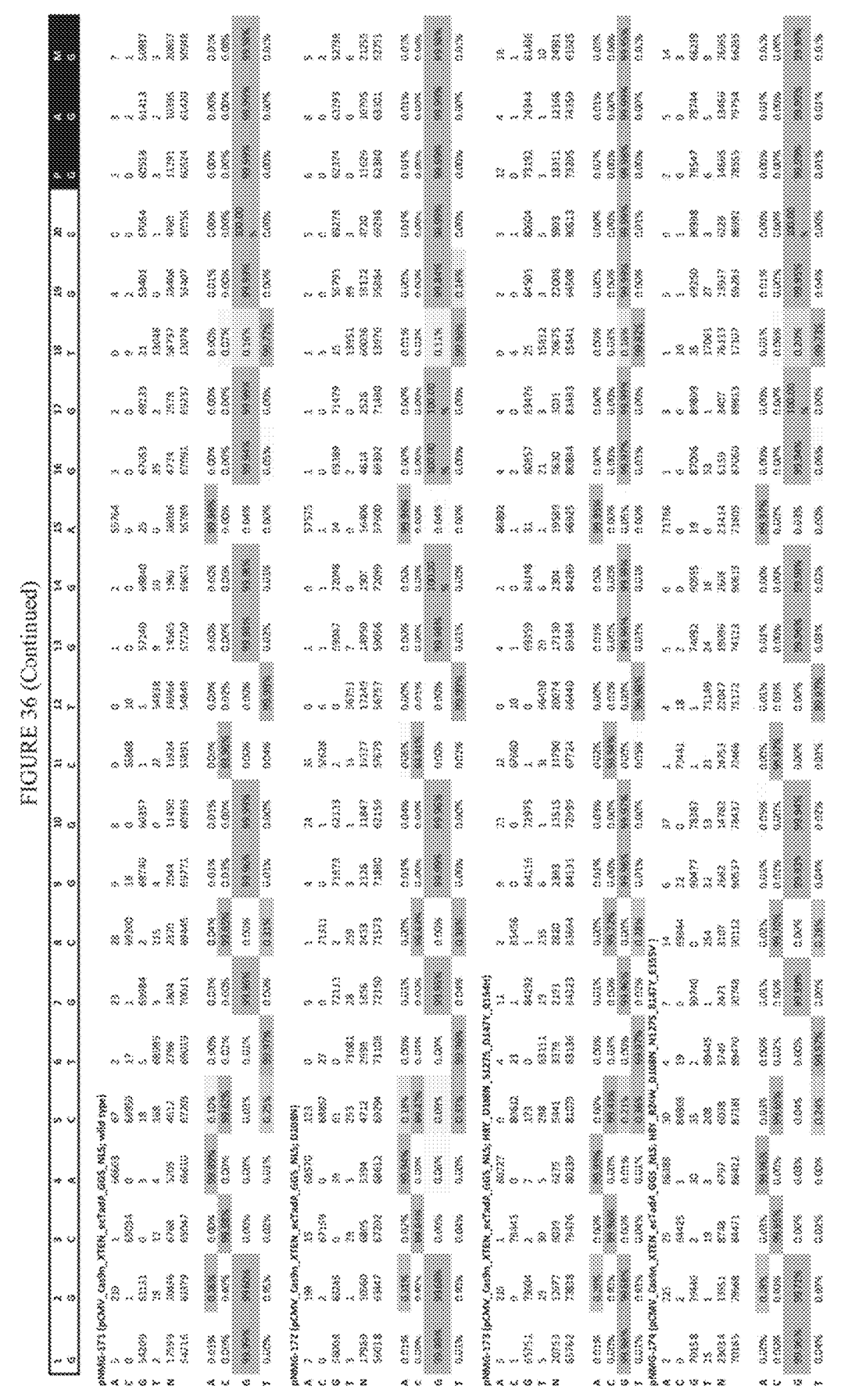
Figure 36:
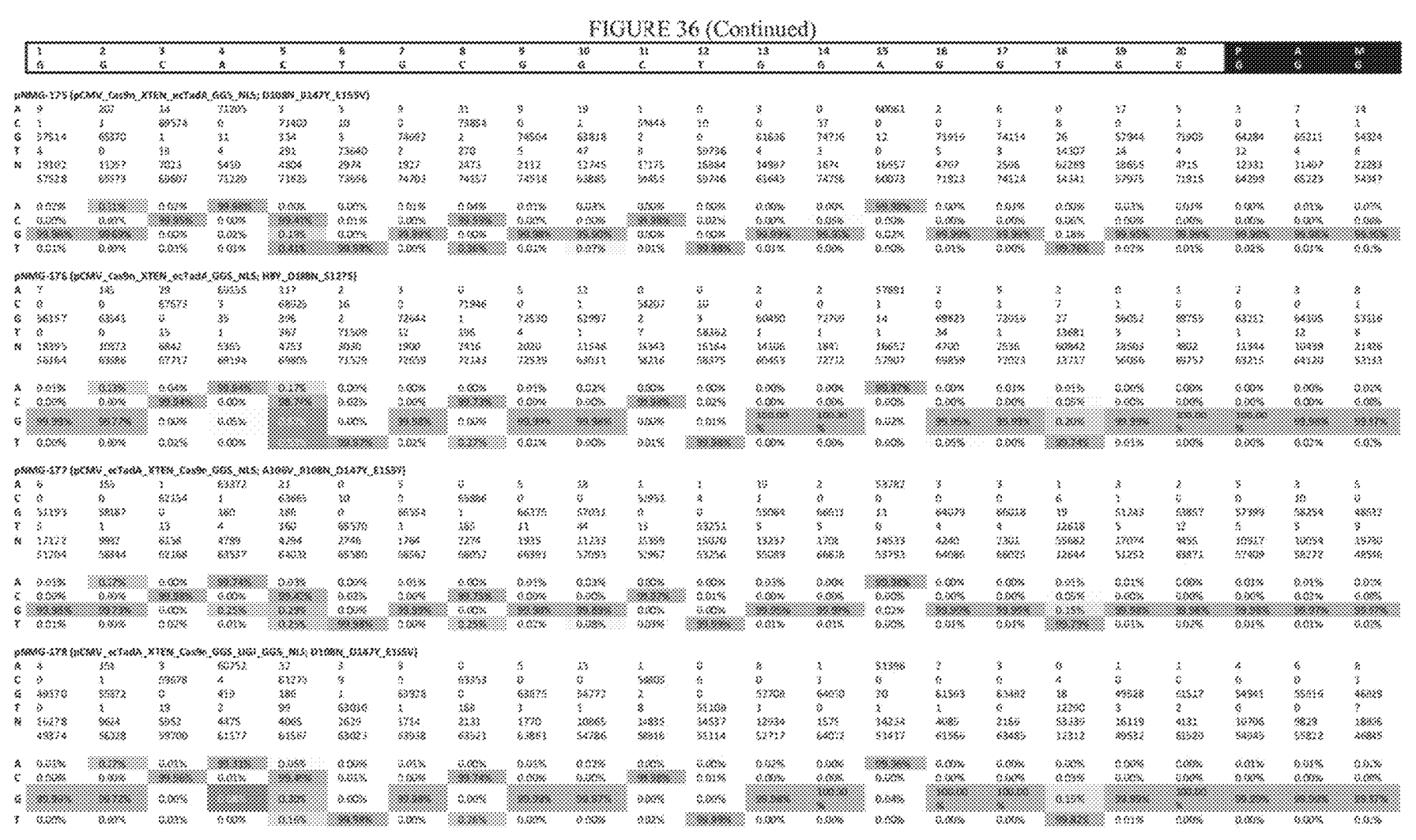
Figure 36:
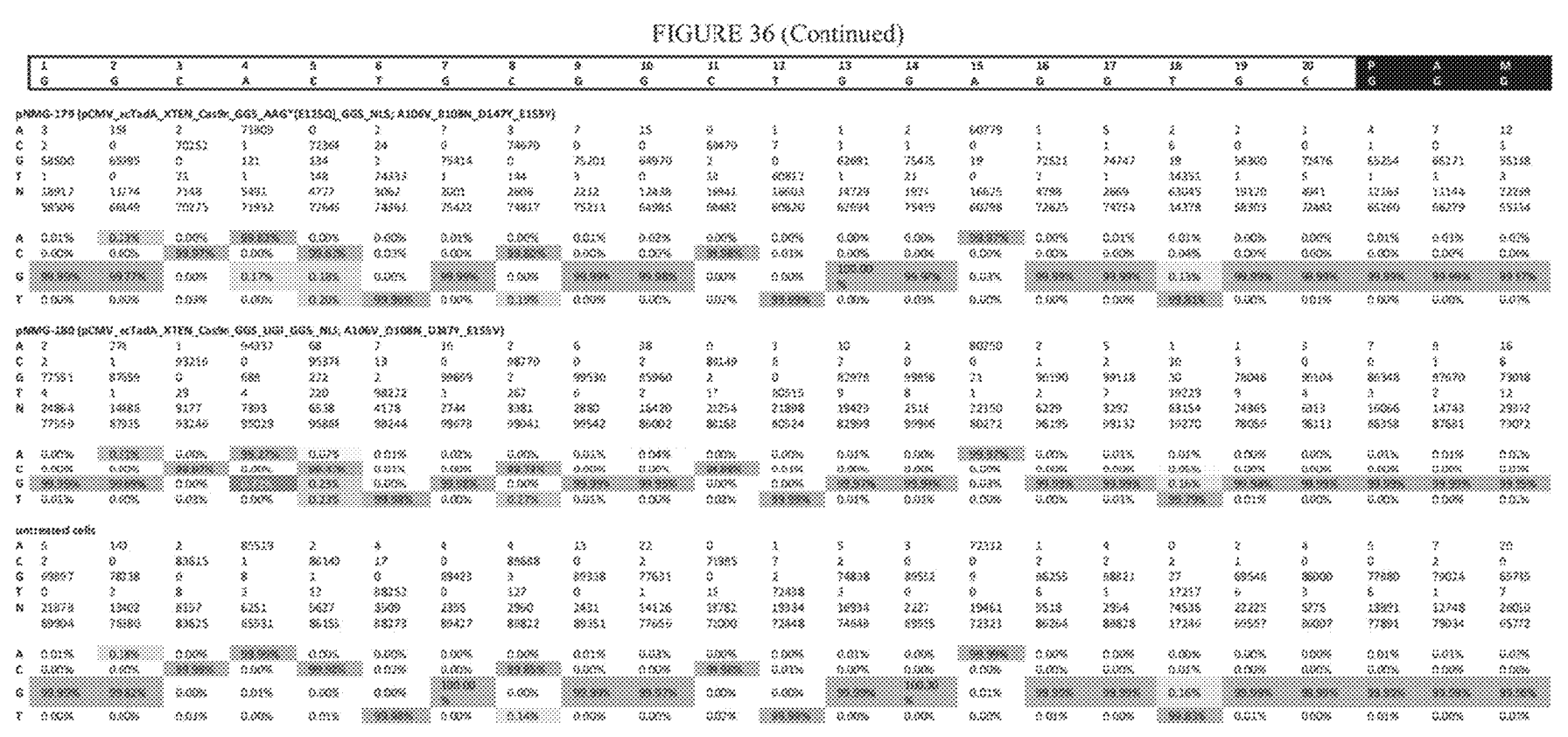

FIG. 36 shows the results of C-terminal fusion at the Hek-4 site. The sequence corresponds to SEQ ID NO: 43.

Figure 37:
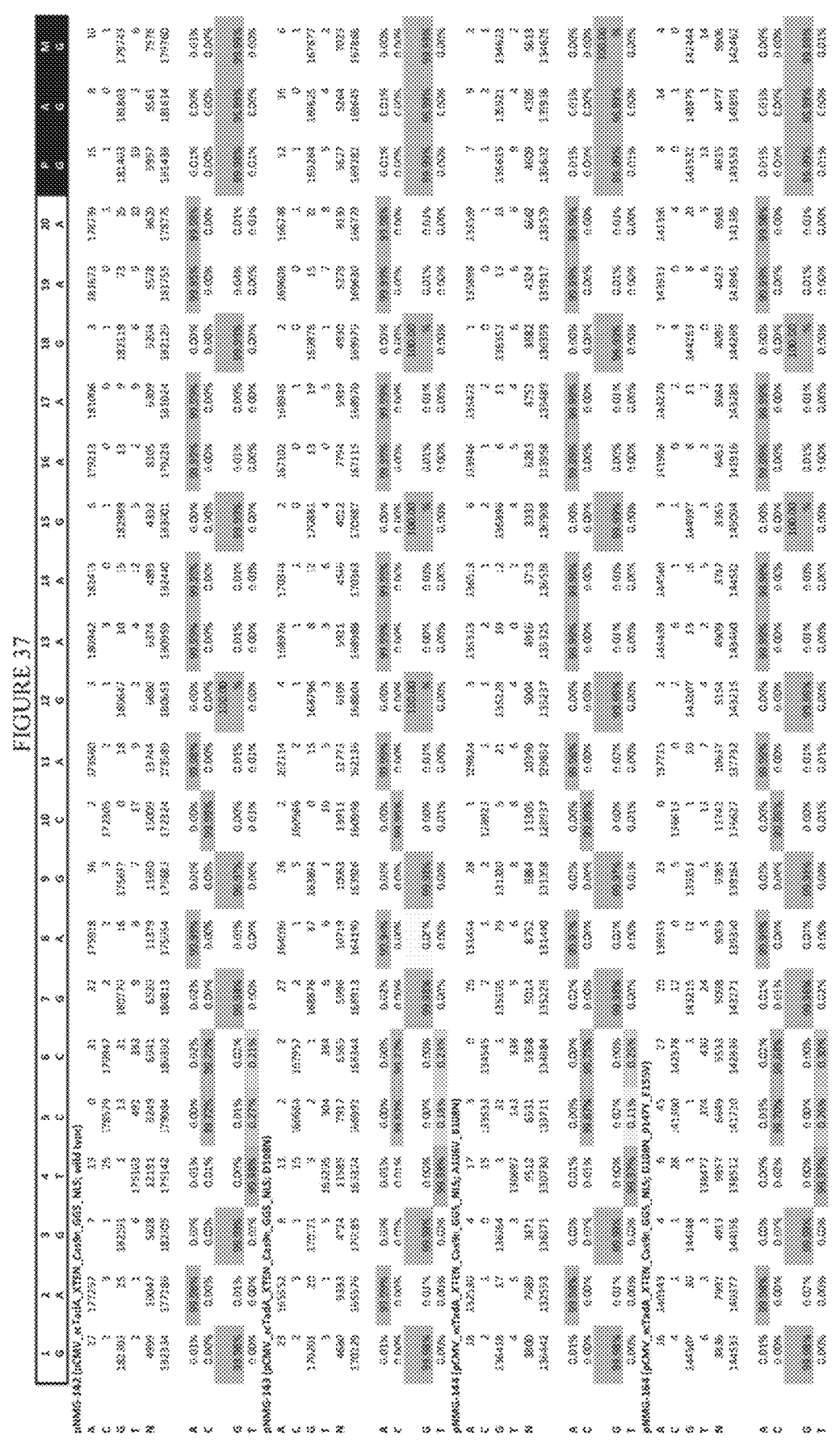
Figure 37:
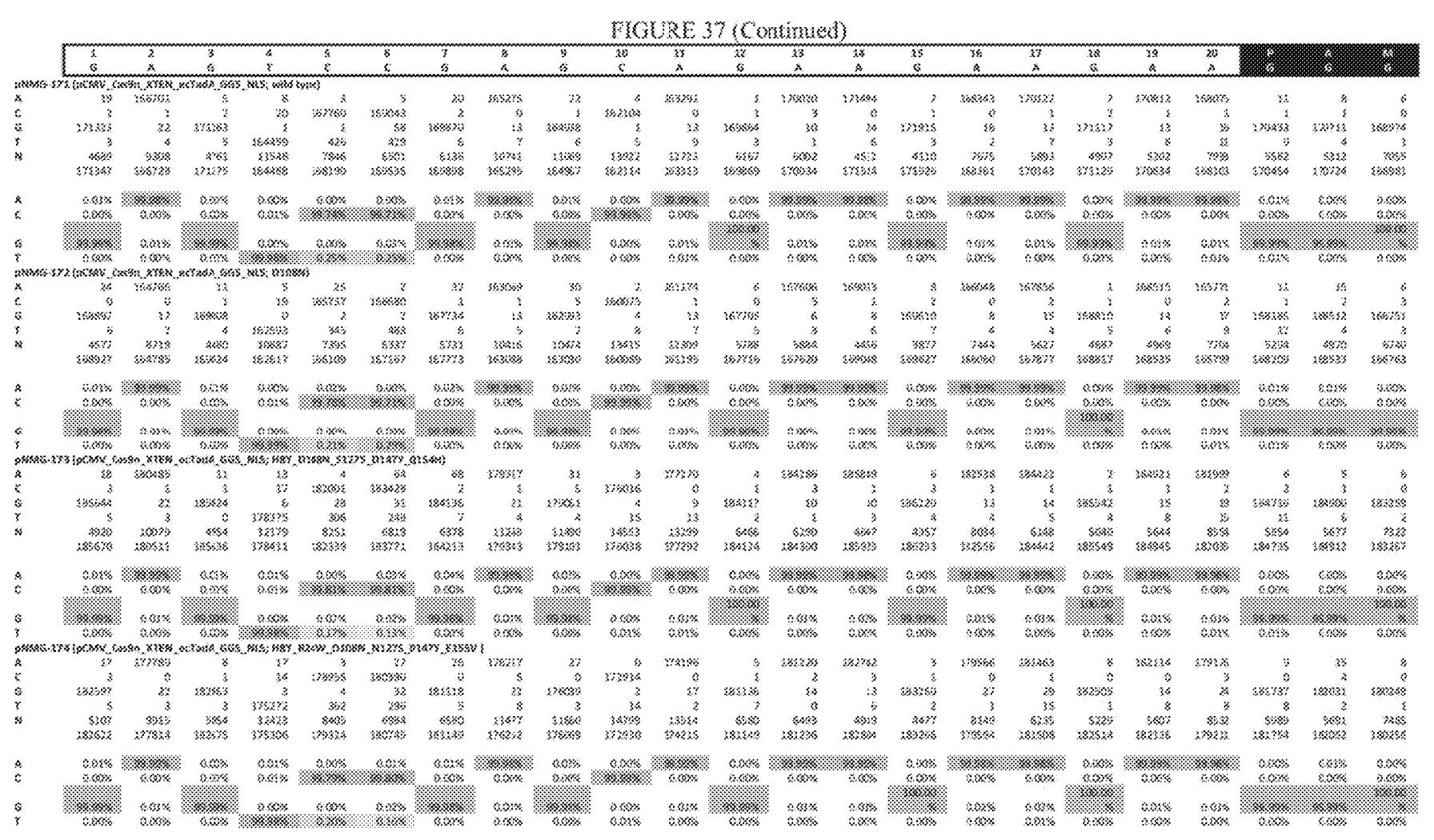
Figure 37:
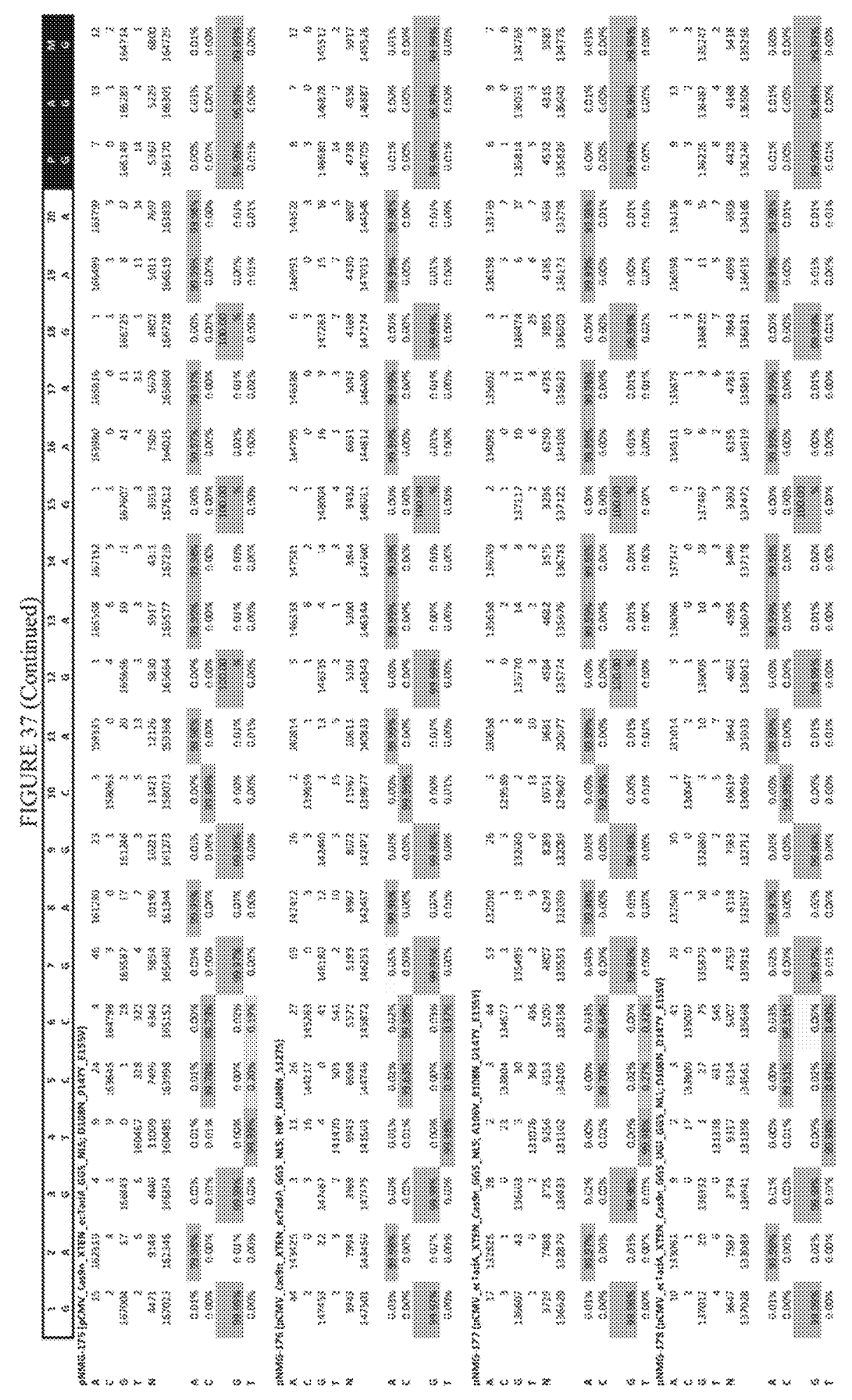
Figure 37:
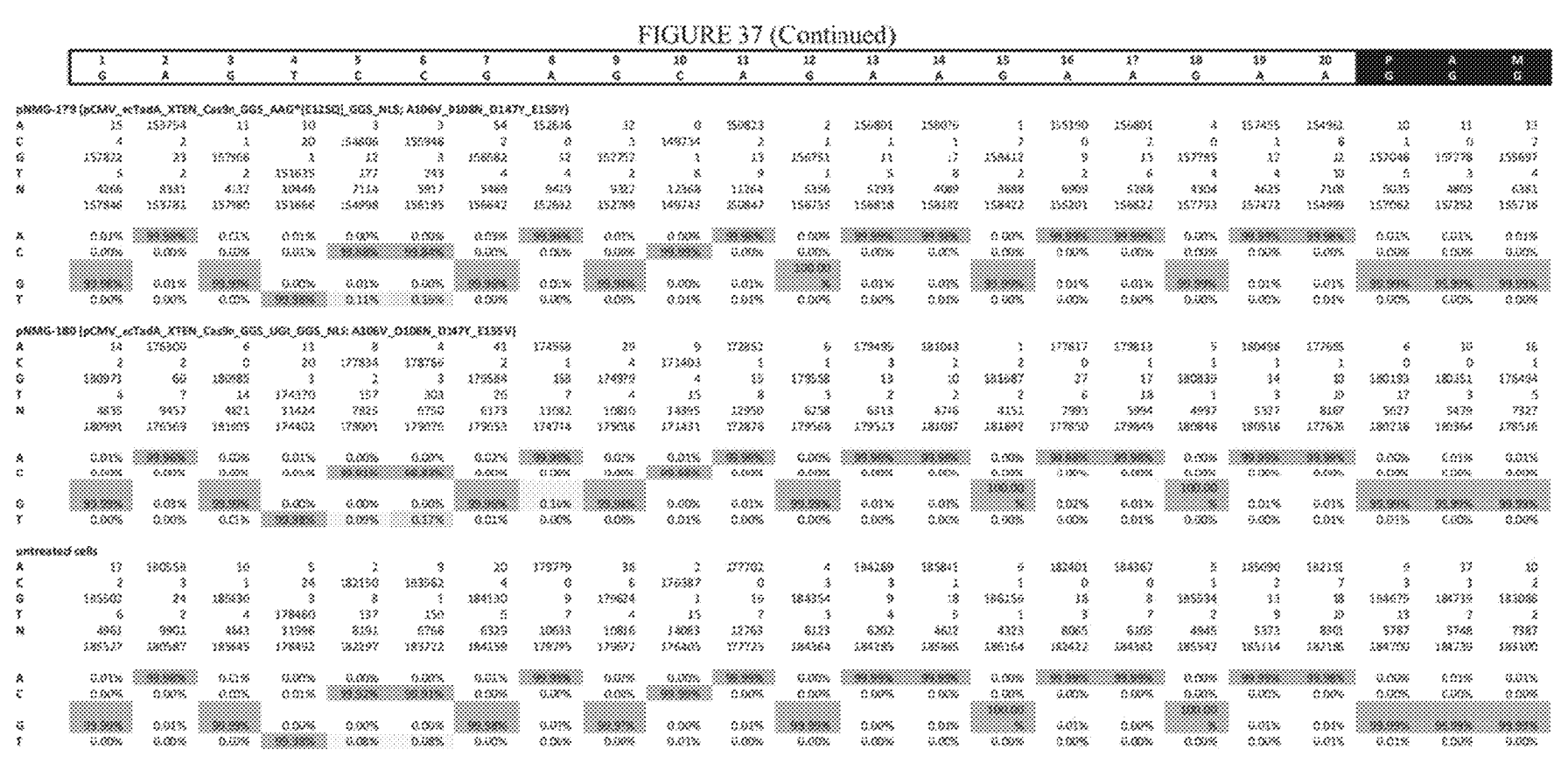

FIG. 37 shows the results of C-terminal fusion at the EMX-1 site. The sequence corresponds to SEQ ID NO: 46.

Figure 38:
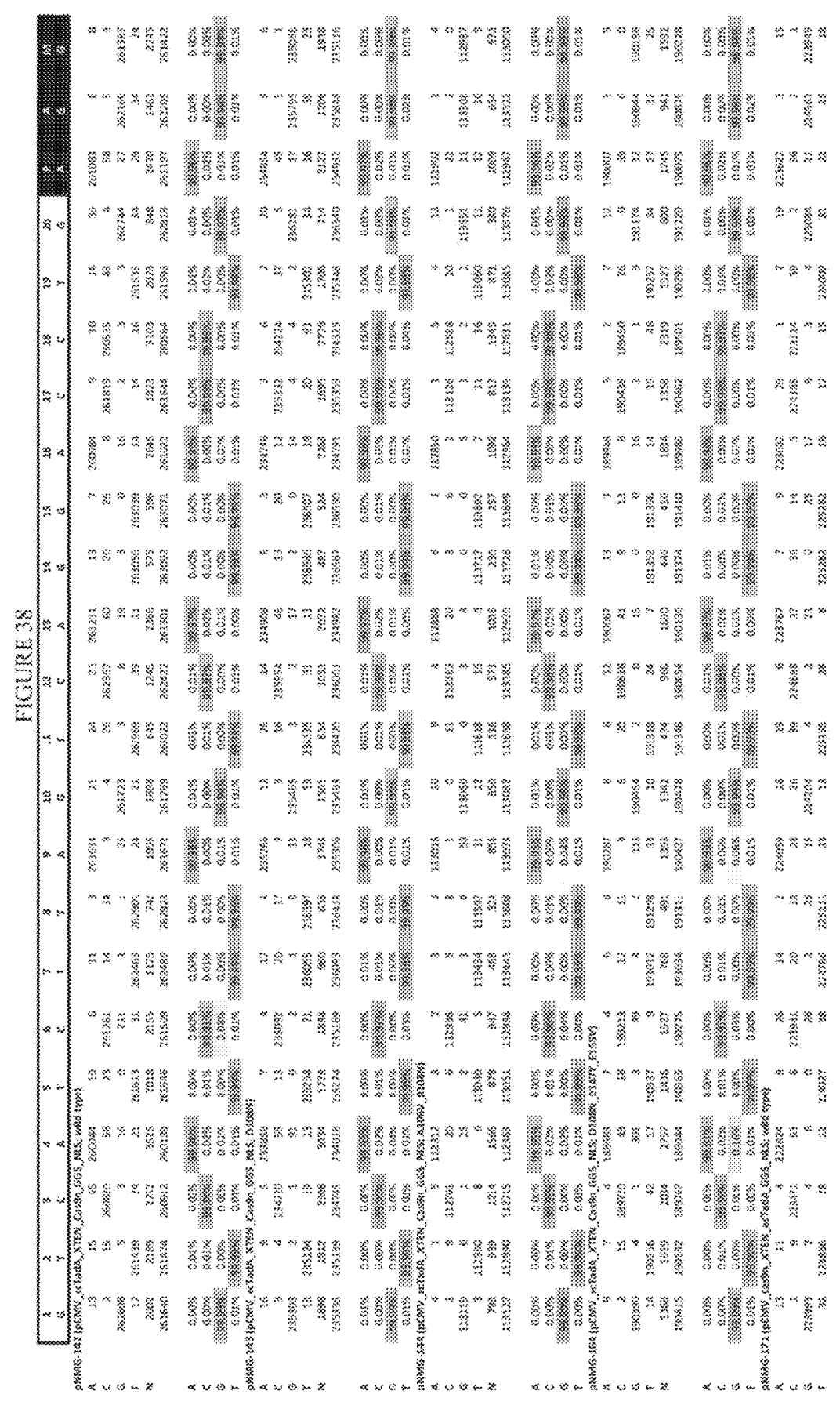
Figure 38:
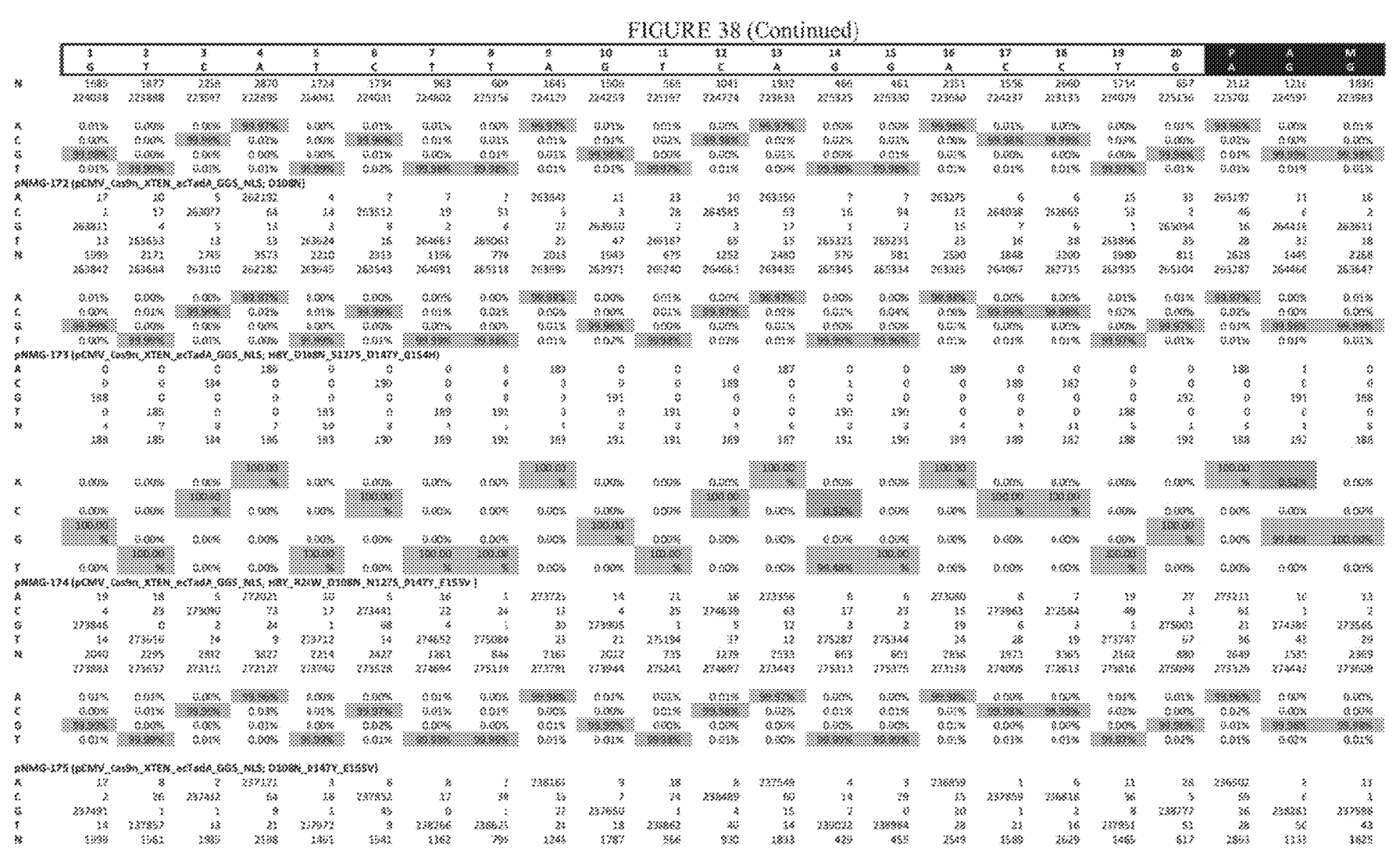
Figure 38:
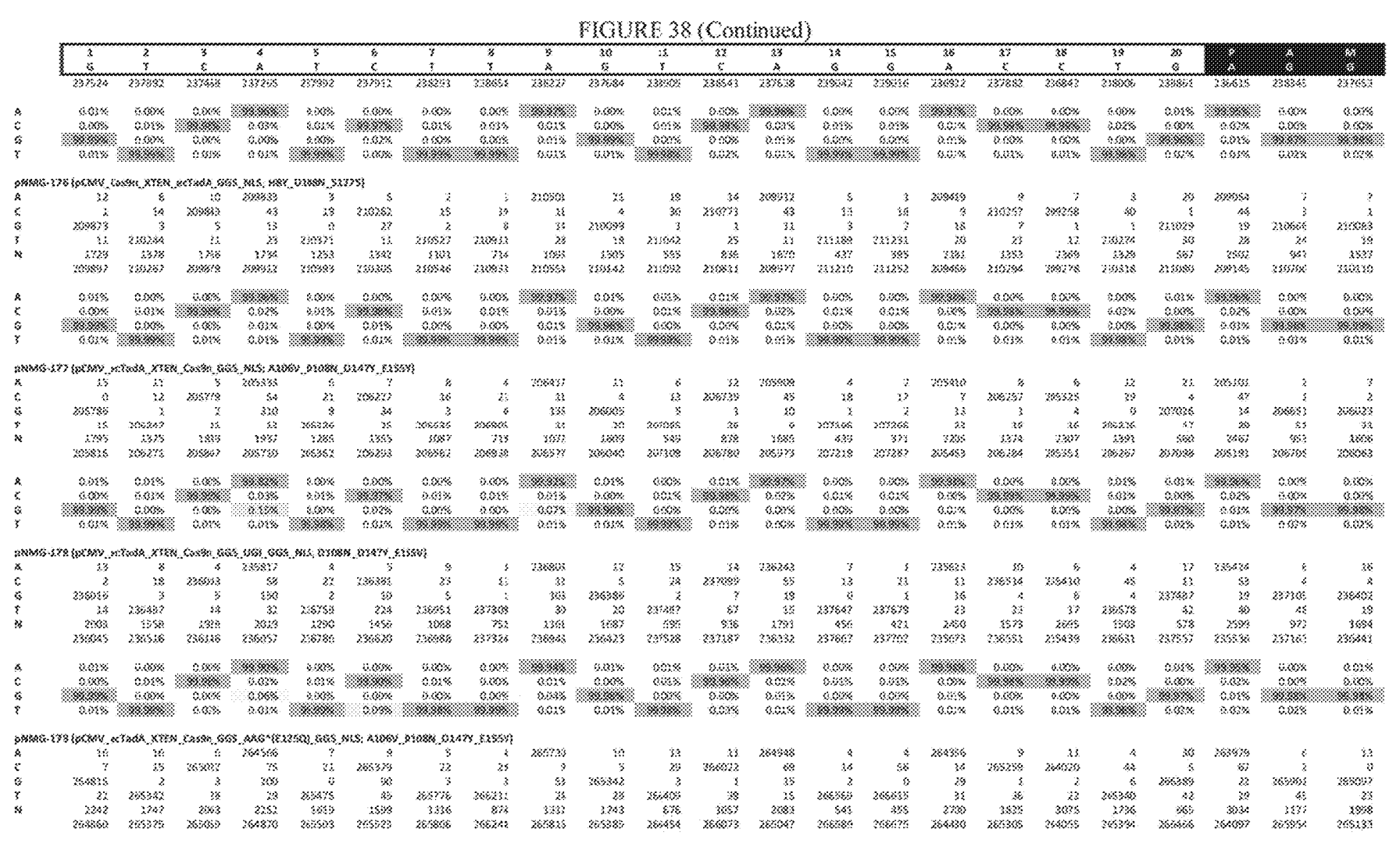
Figure 38:
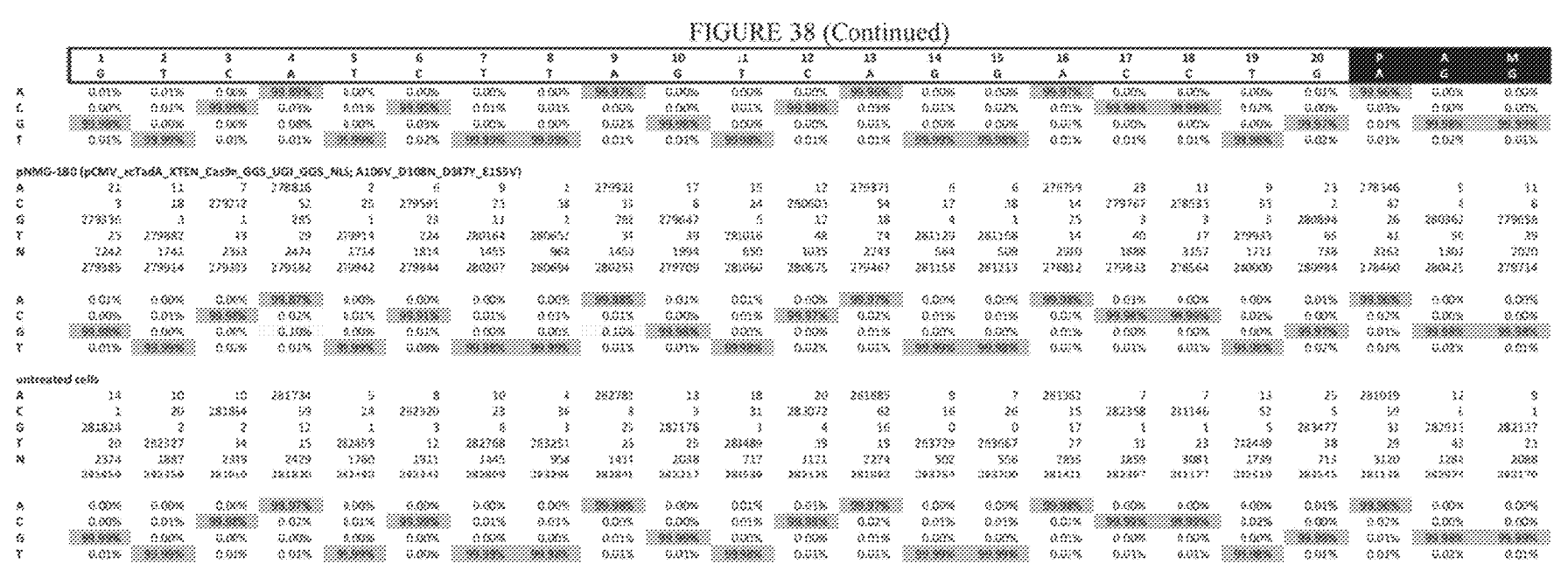

FIG. 38 shows the results of C-terminal fusion at the RNF-2 site. The sequence corresponds to SEQ ID NO: 44.

Figure 39:
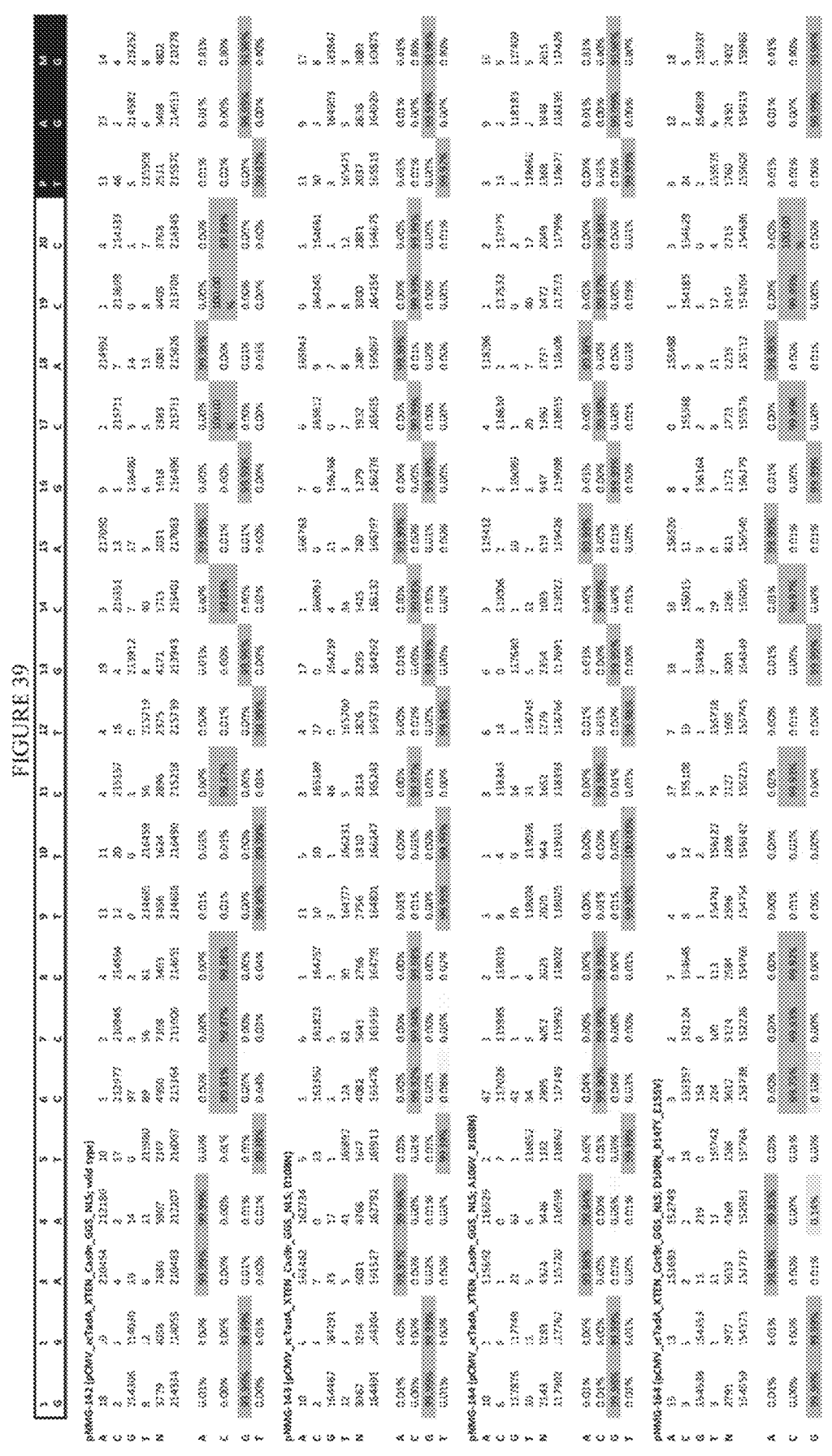
Figure 39:
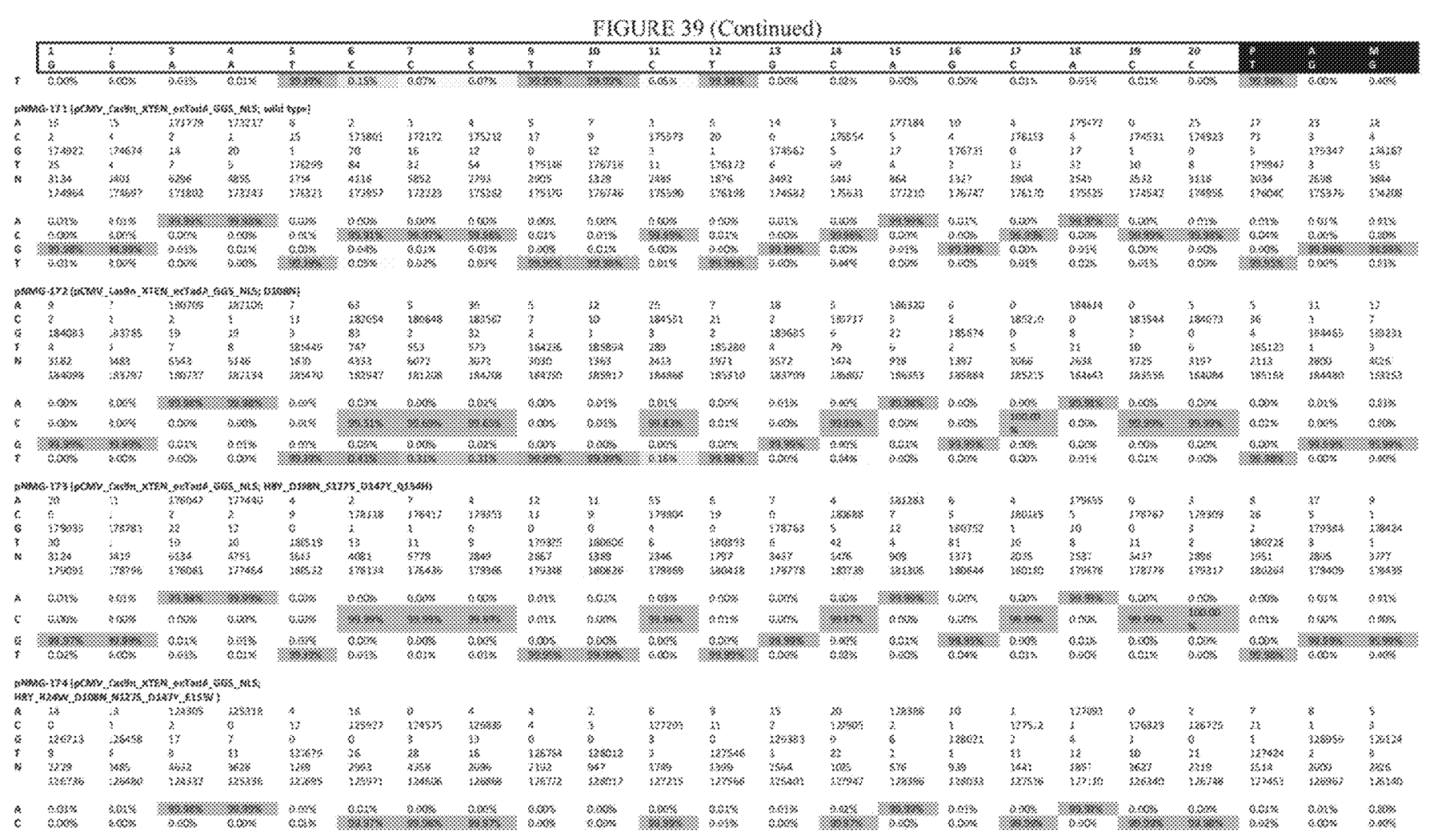
Figure 39:
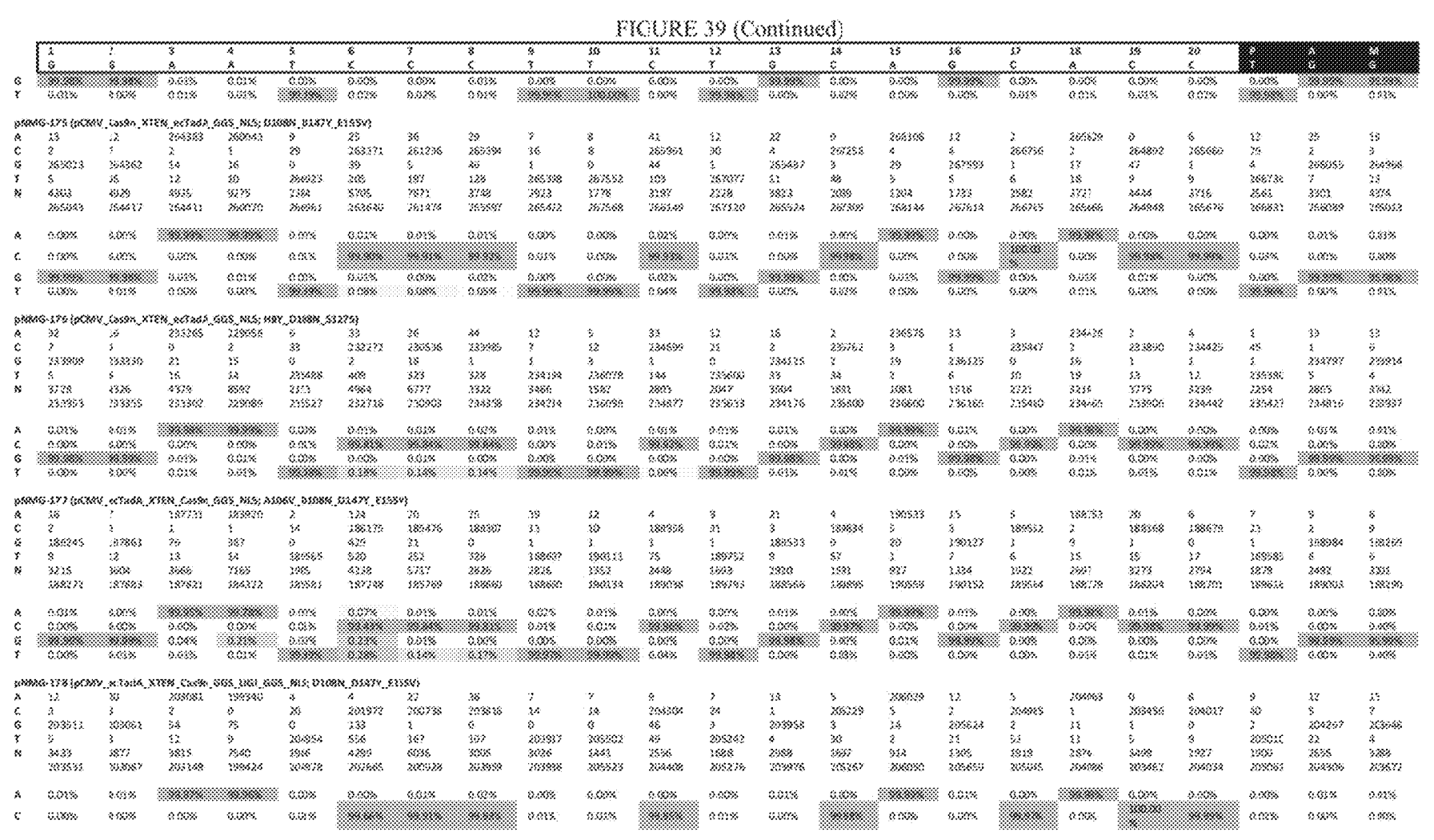
Figure 39:
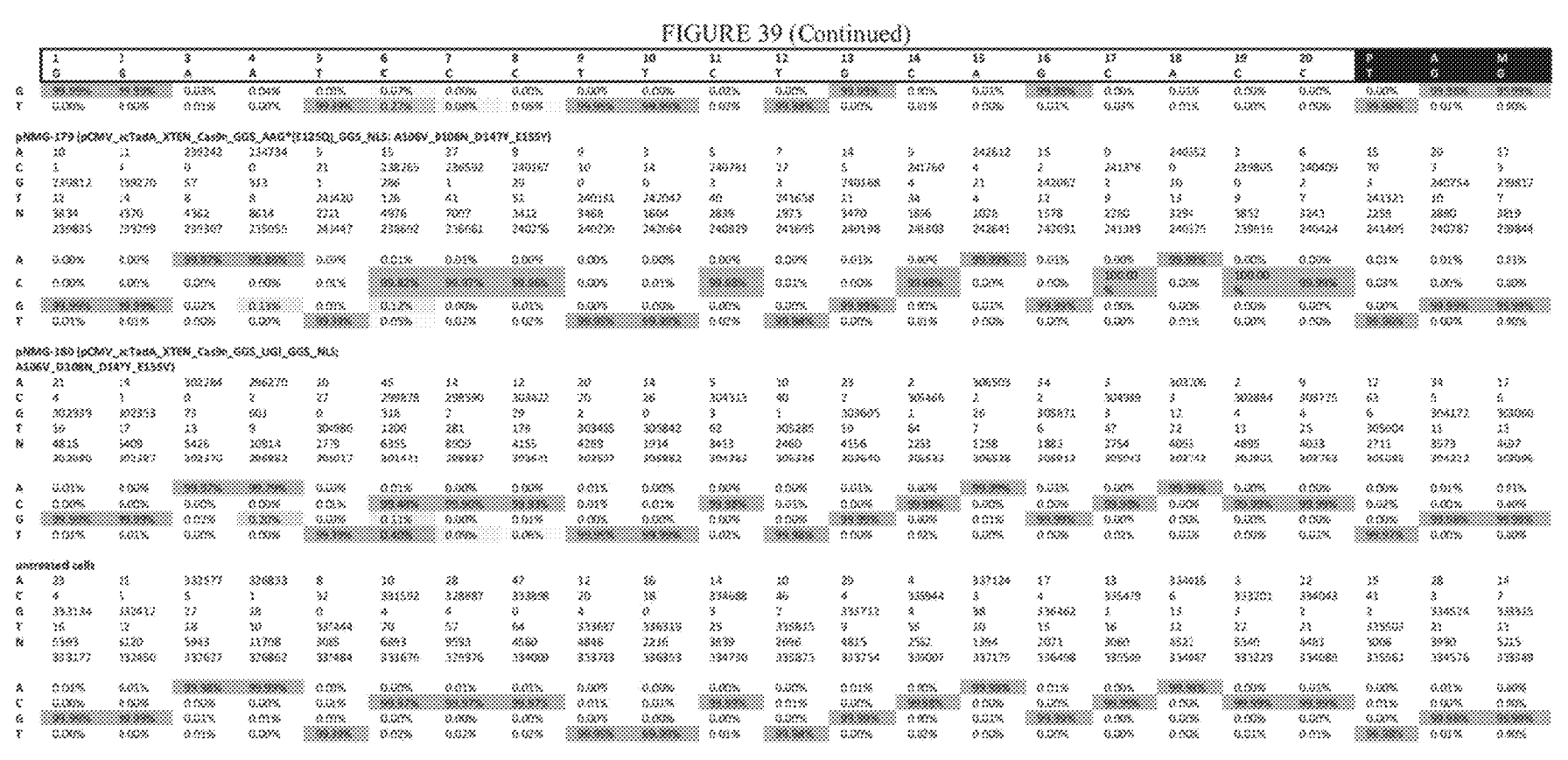

FIG. 39 shows the results of C-terminal fusion at the FANCF site. The sequence corresponds to SEQ ID NO: 45.

FIG. 40 shows the results of transfection at the Hek-2 site. The sequence corresponds to SEQ ID NO: 41.

Figure 41:
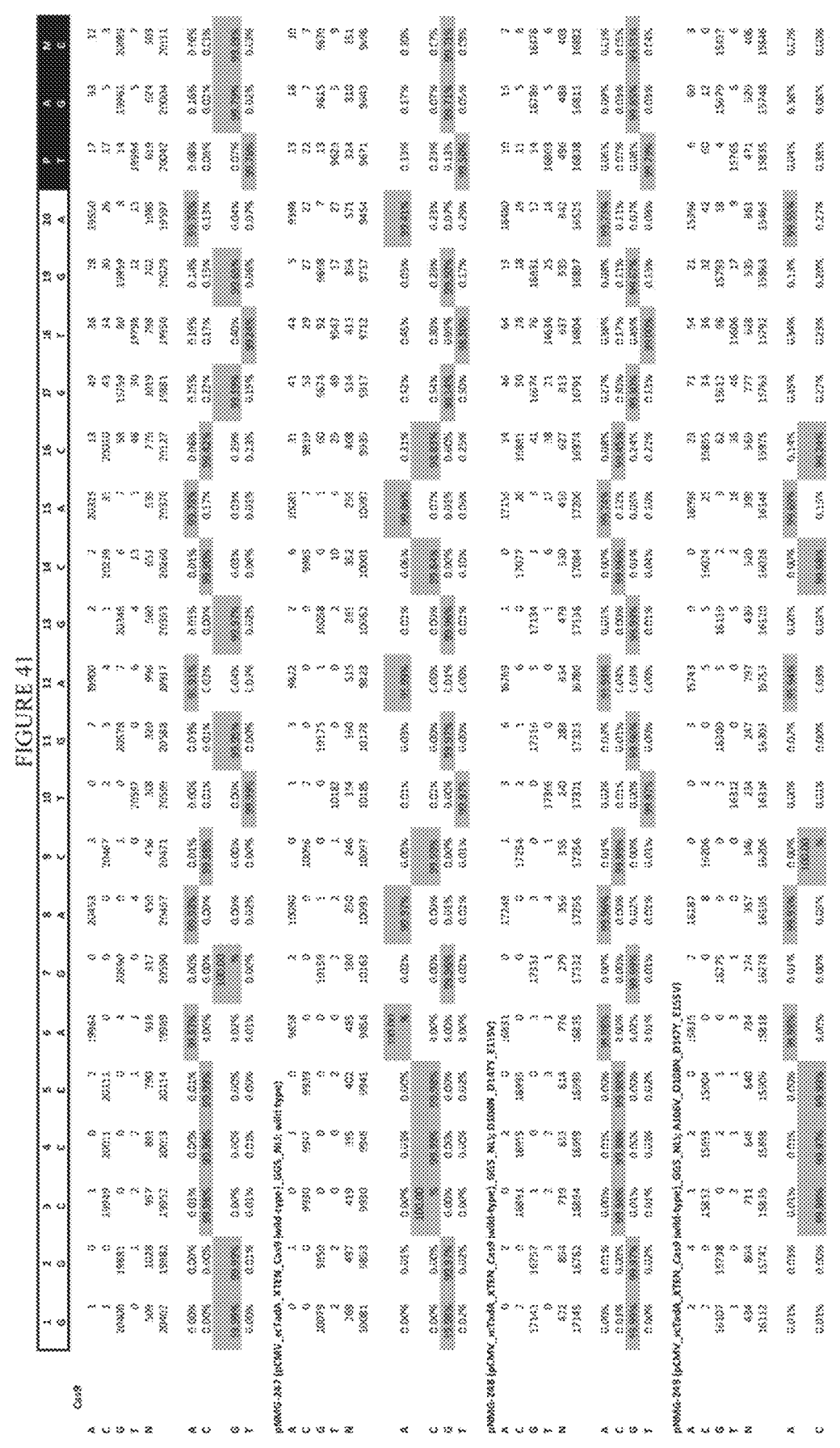
Figure 41:
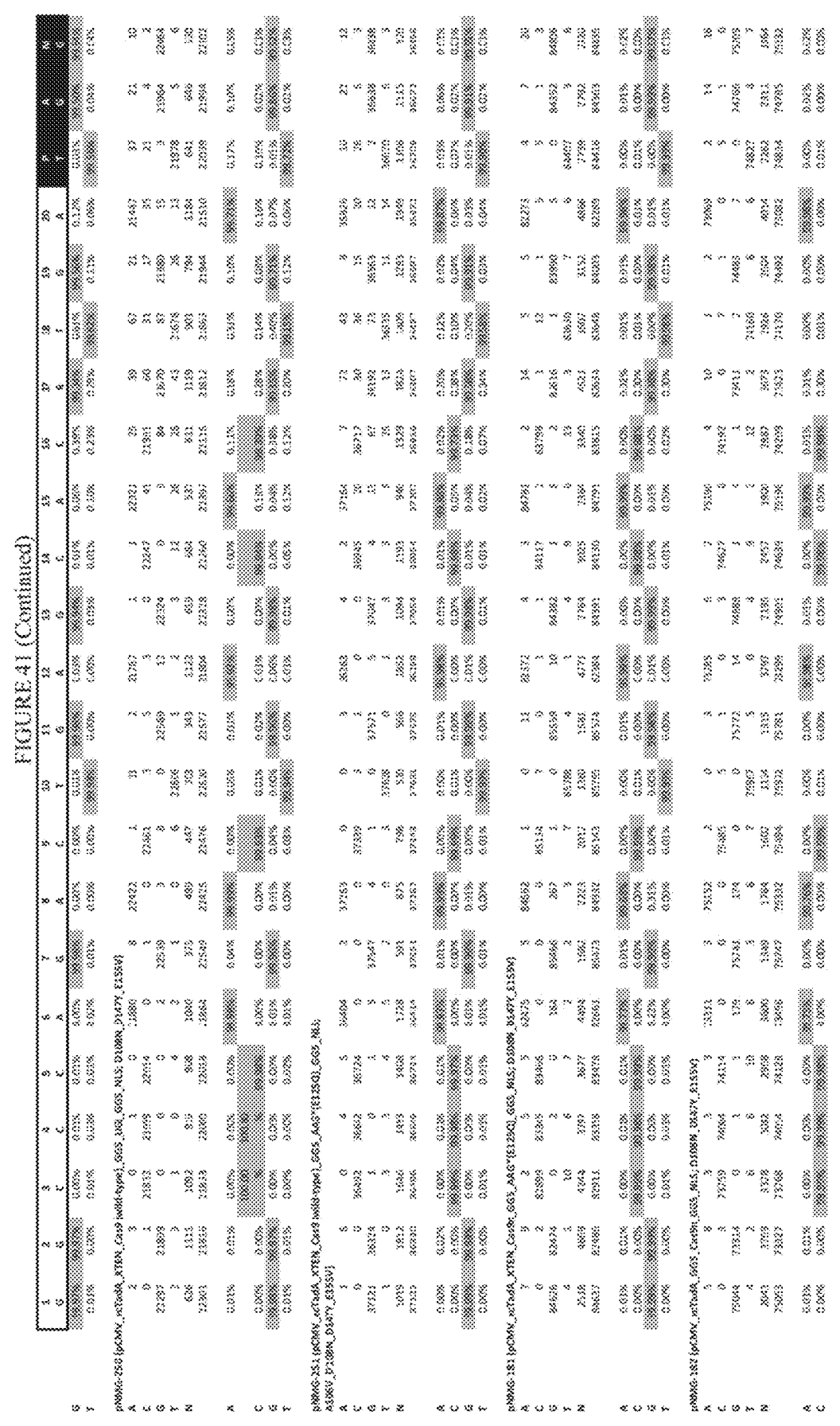
Figure 41:
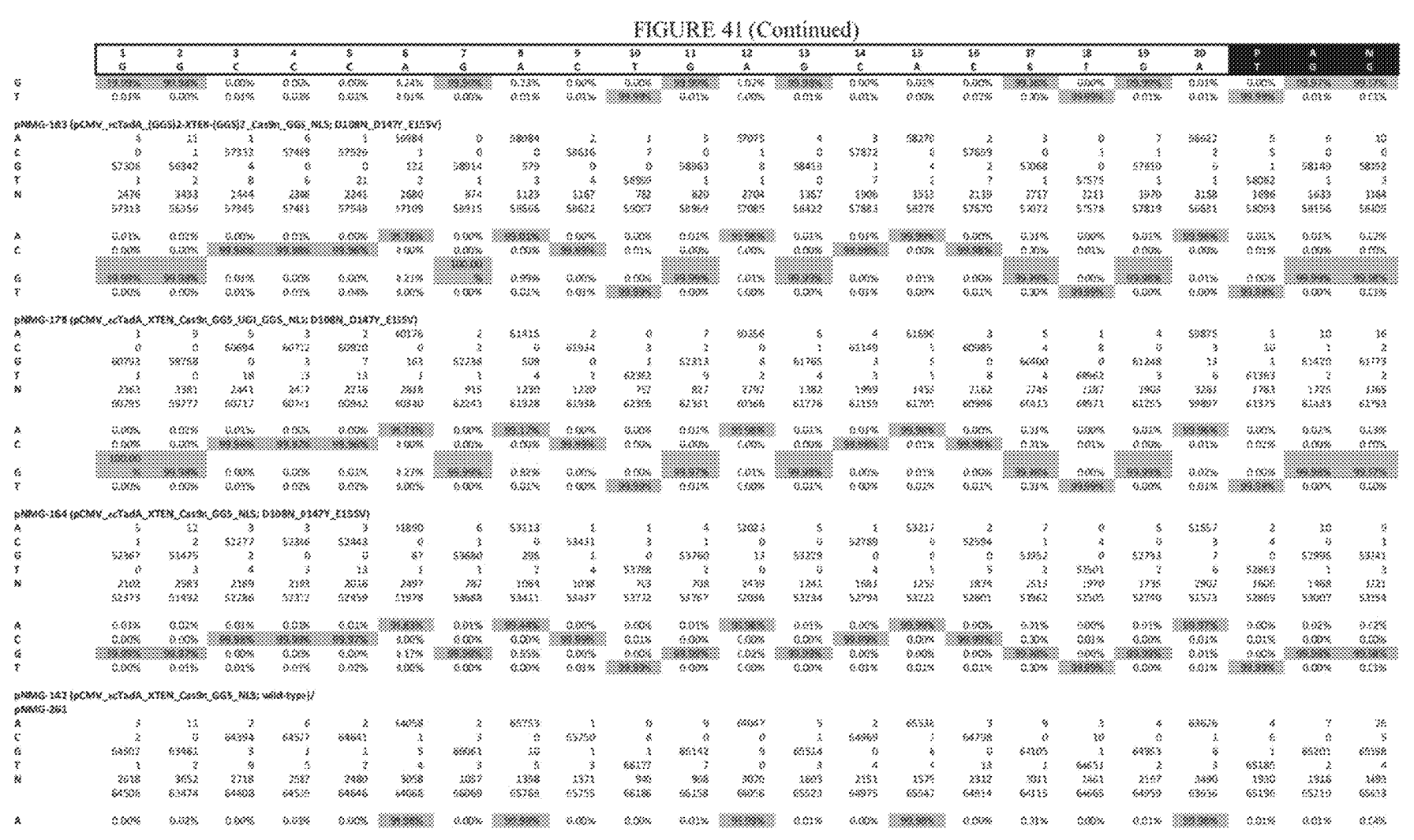
Figure 41:
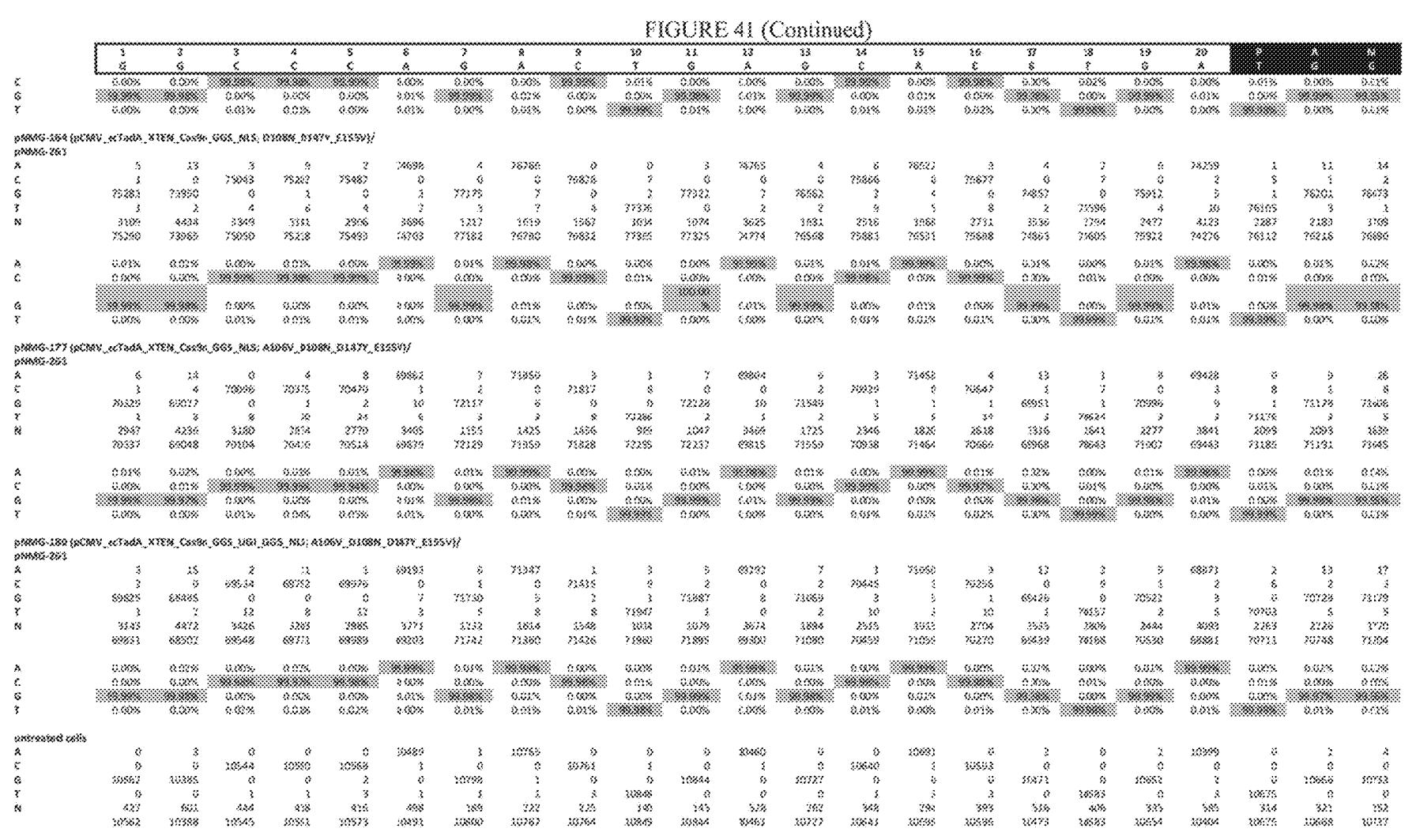
Figure 41:
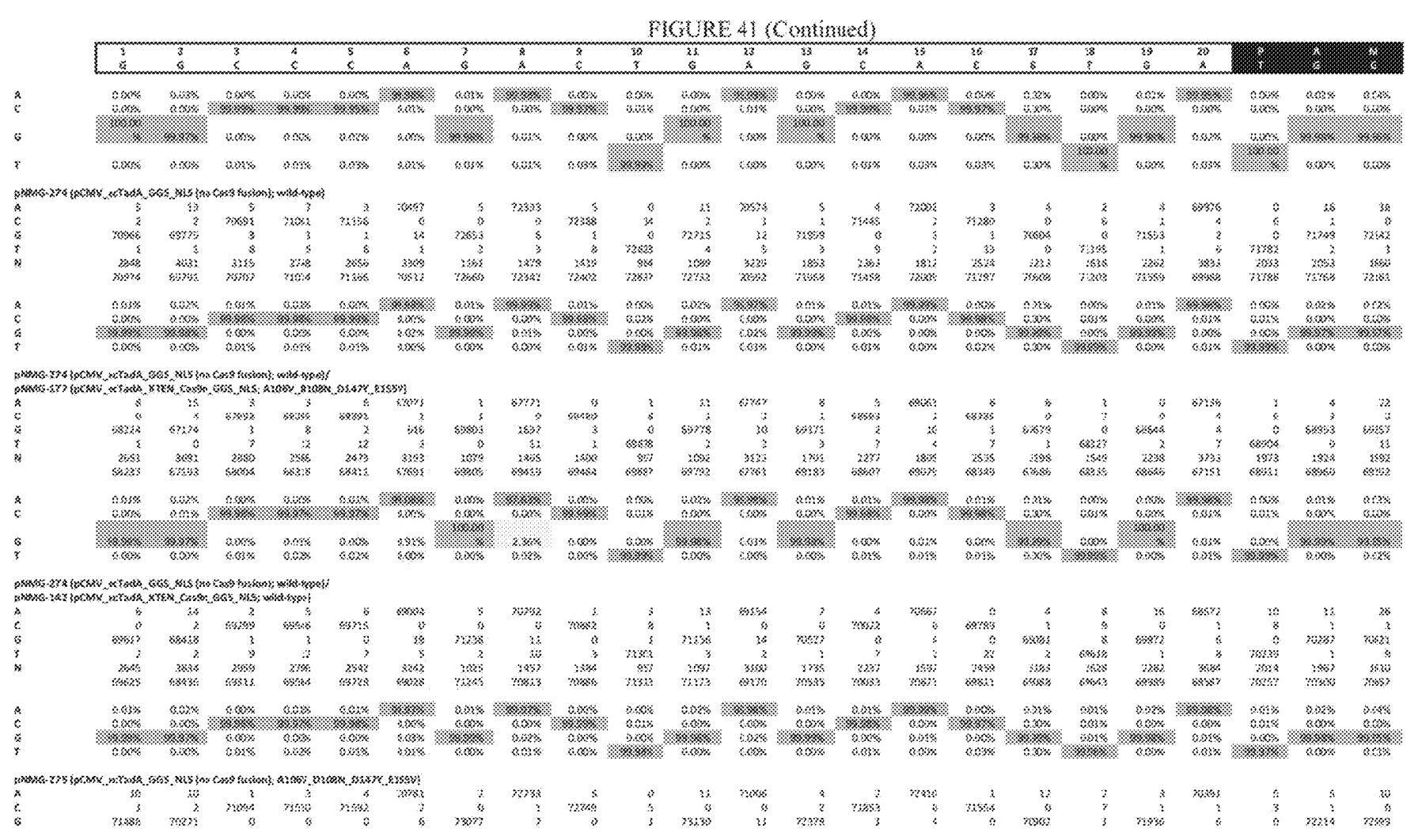
Figure 41:
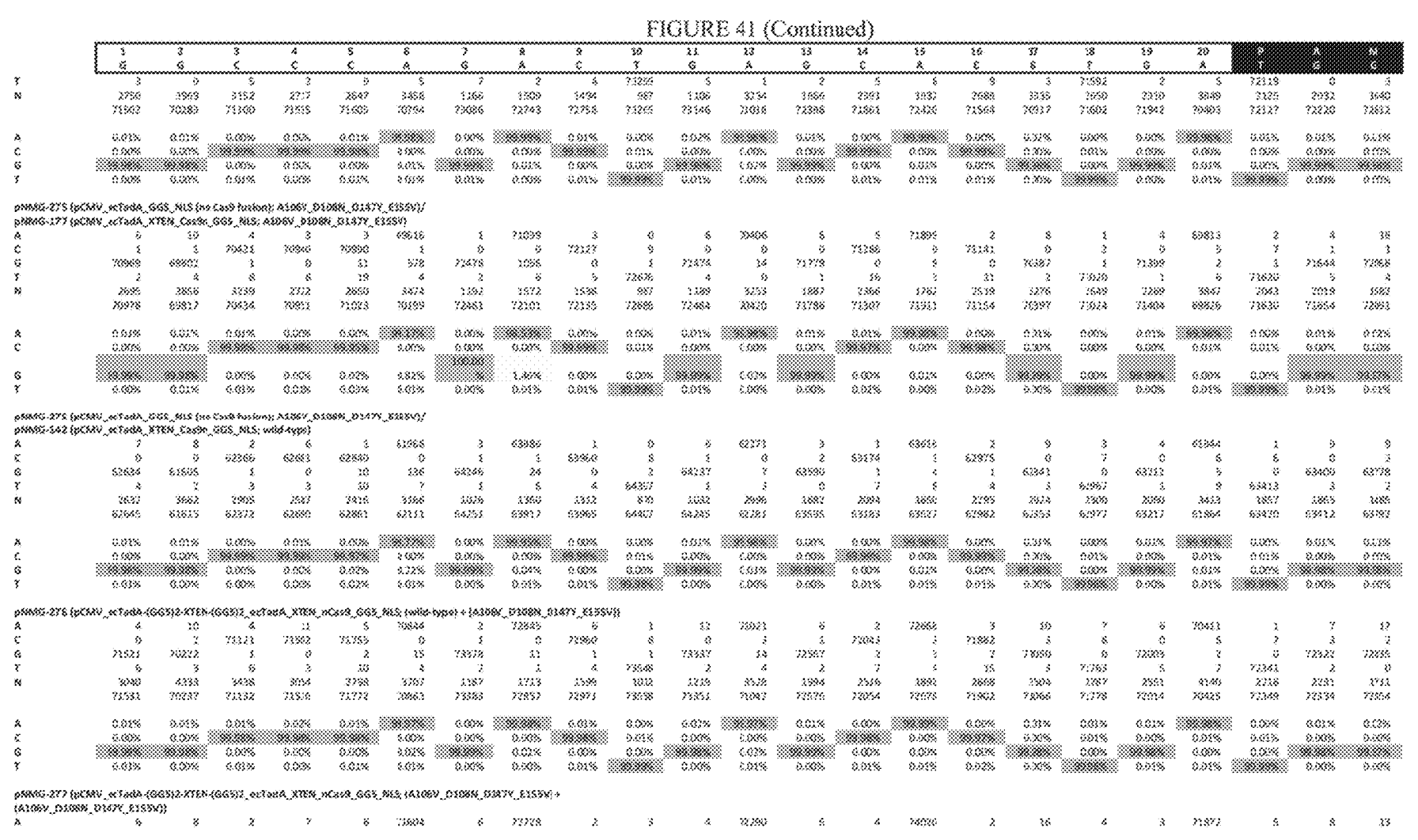
Figure 41:
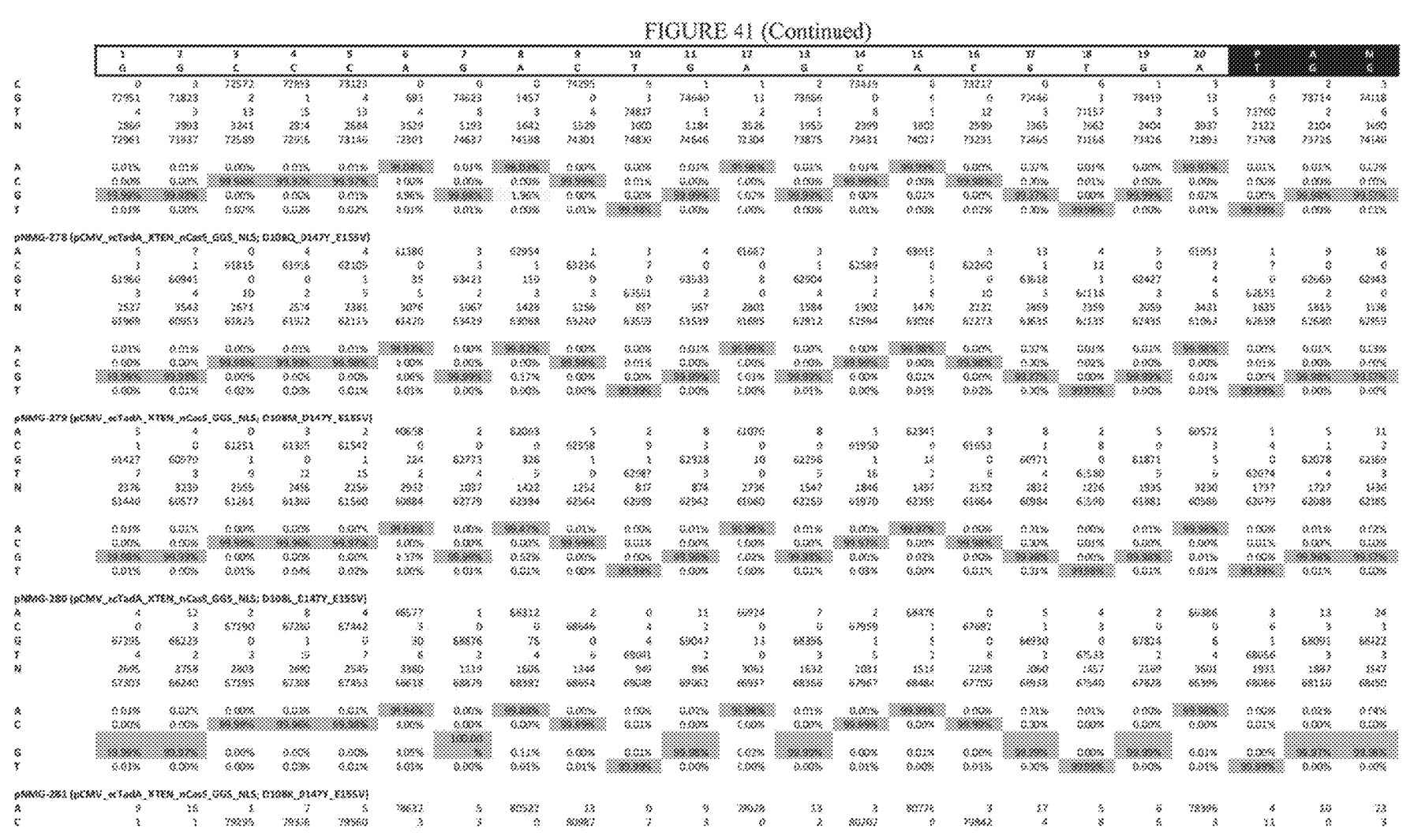
Figure 41:
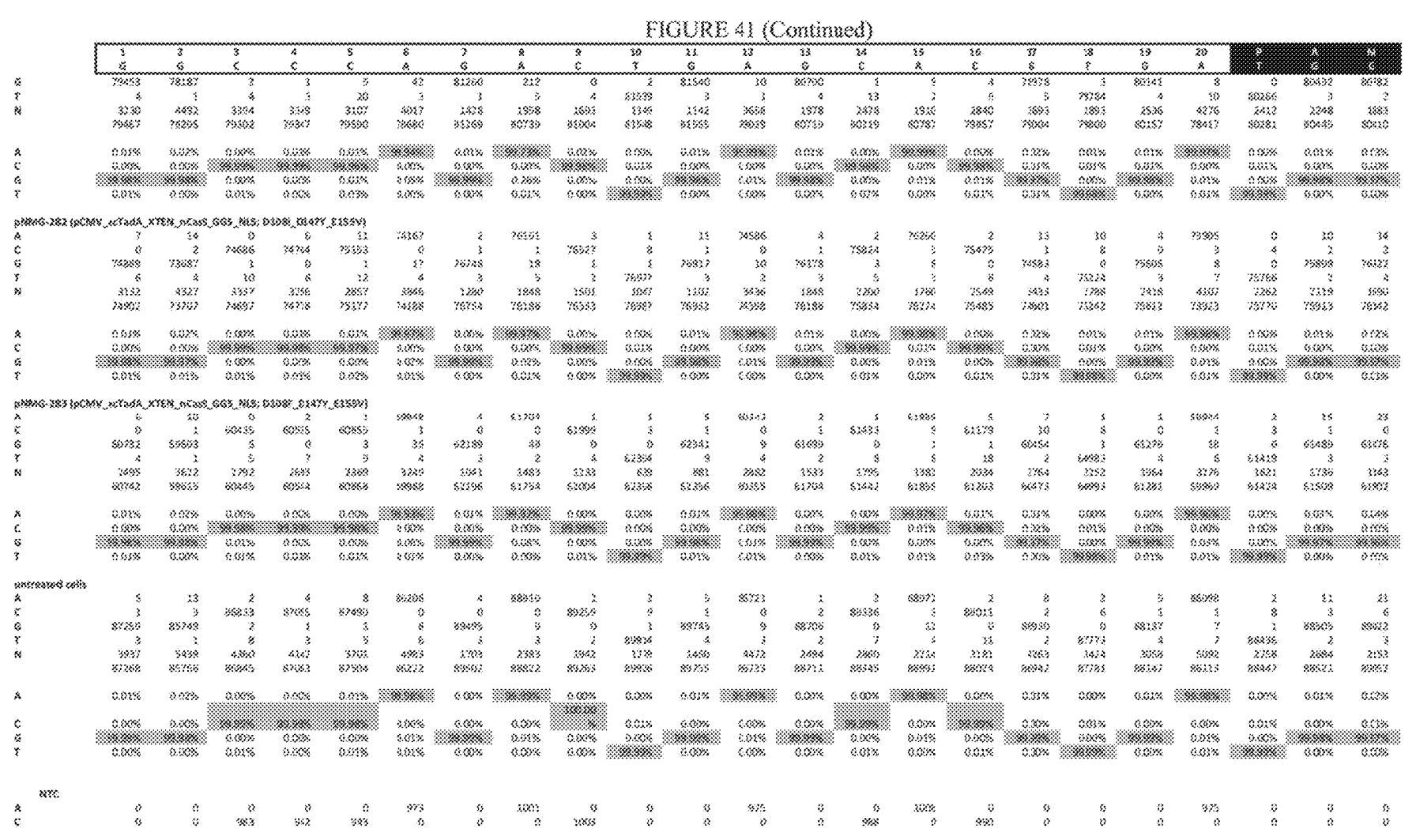
Figure 41:
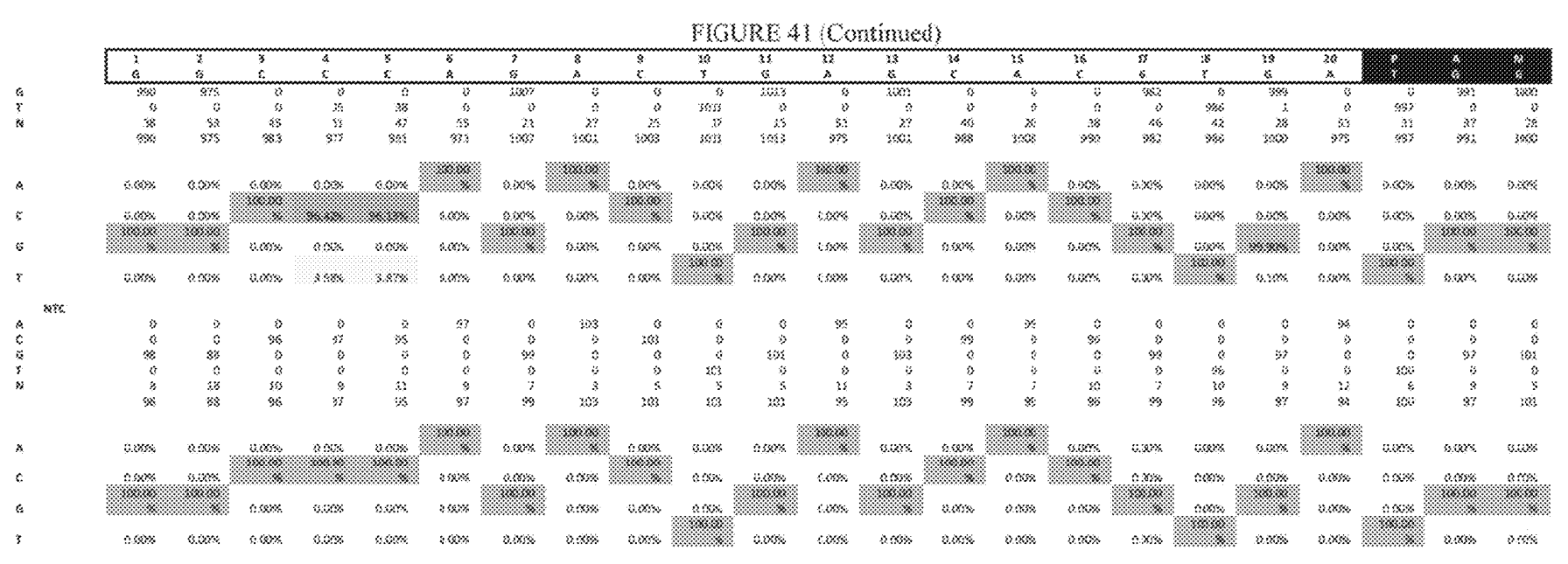

FIG. 41 shows the results of transfection at the Hek-3 site. The sequence corresponds to SEQ ID NO: 42.

Figure 42:
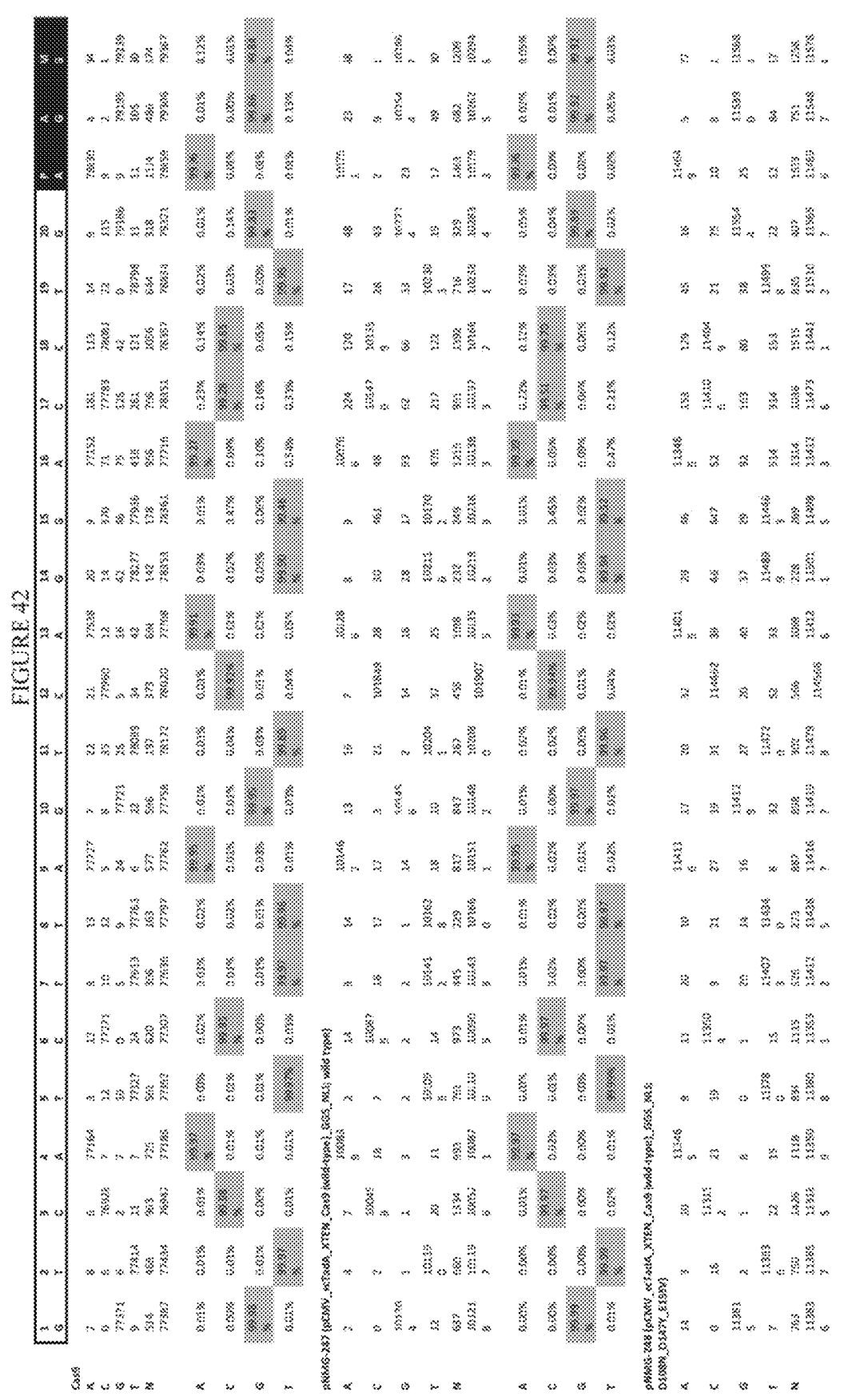
Figure 42:
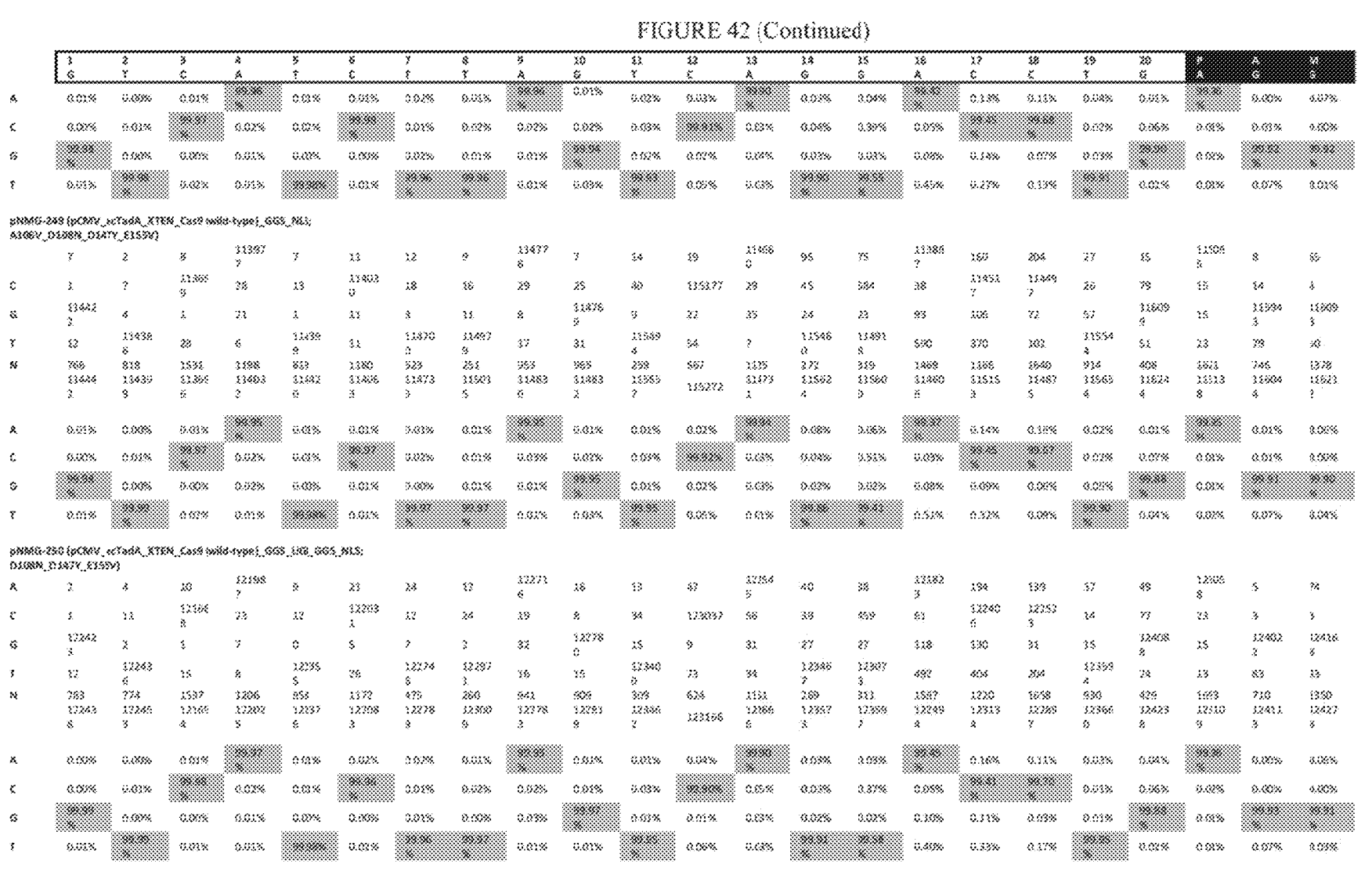
Figure 42:
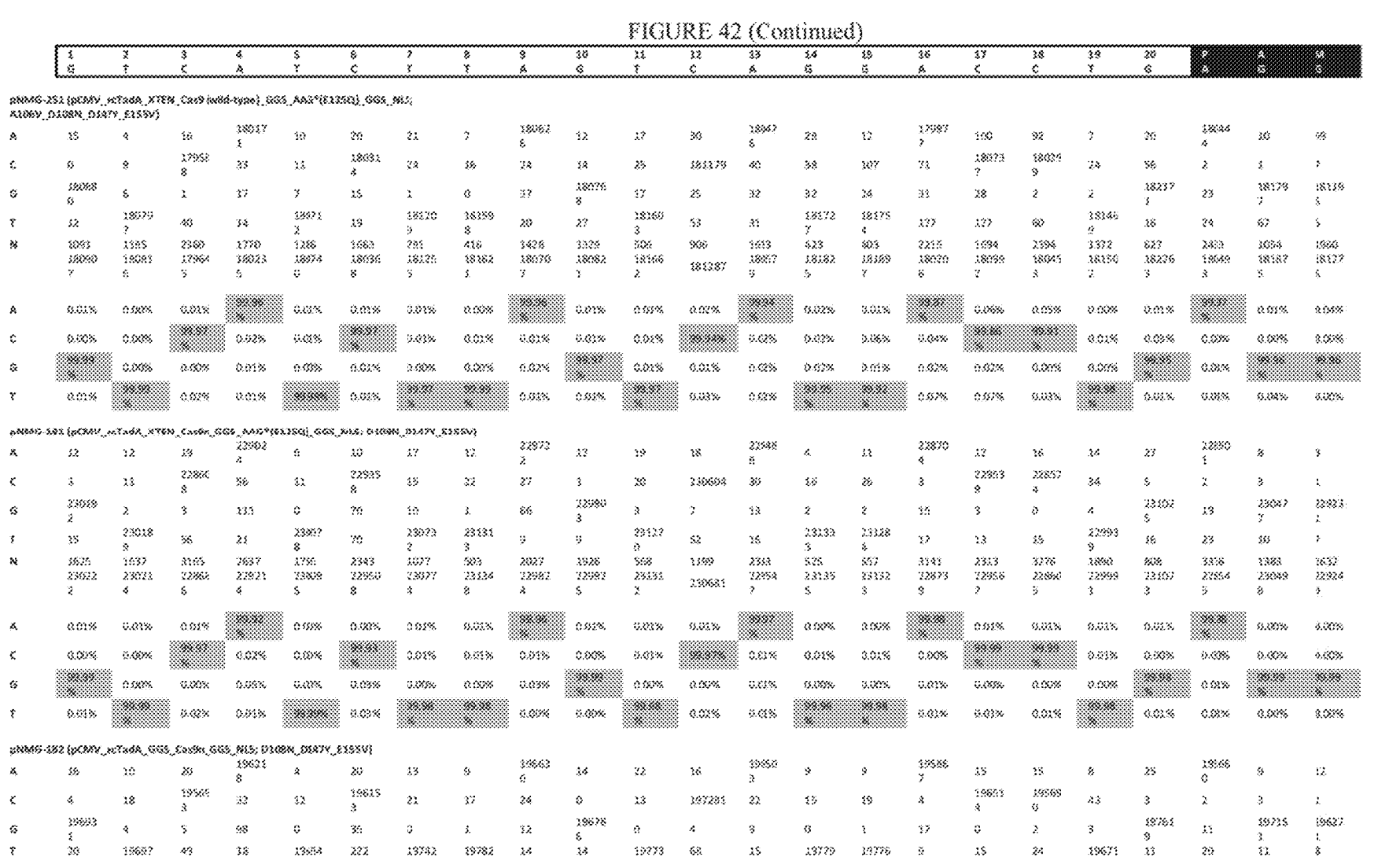
Figure 42:
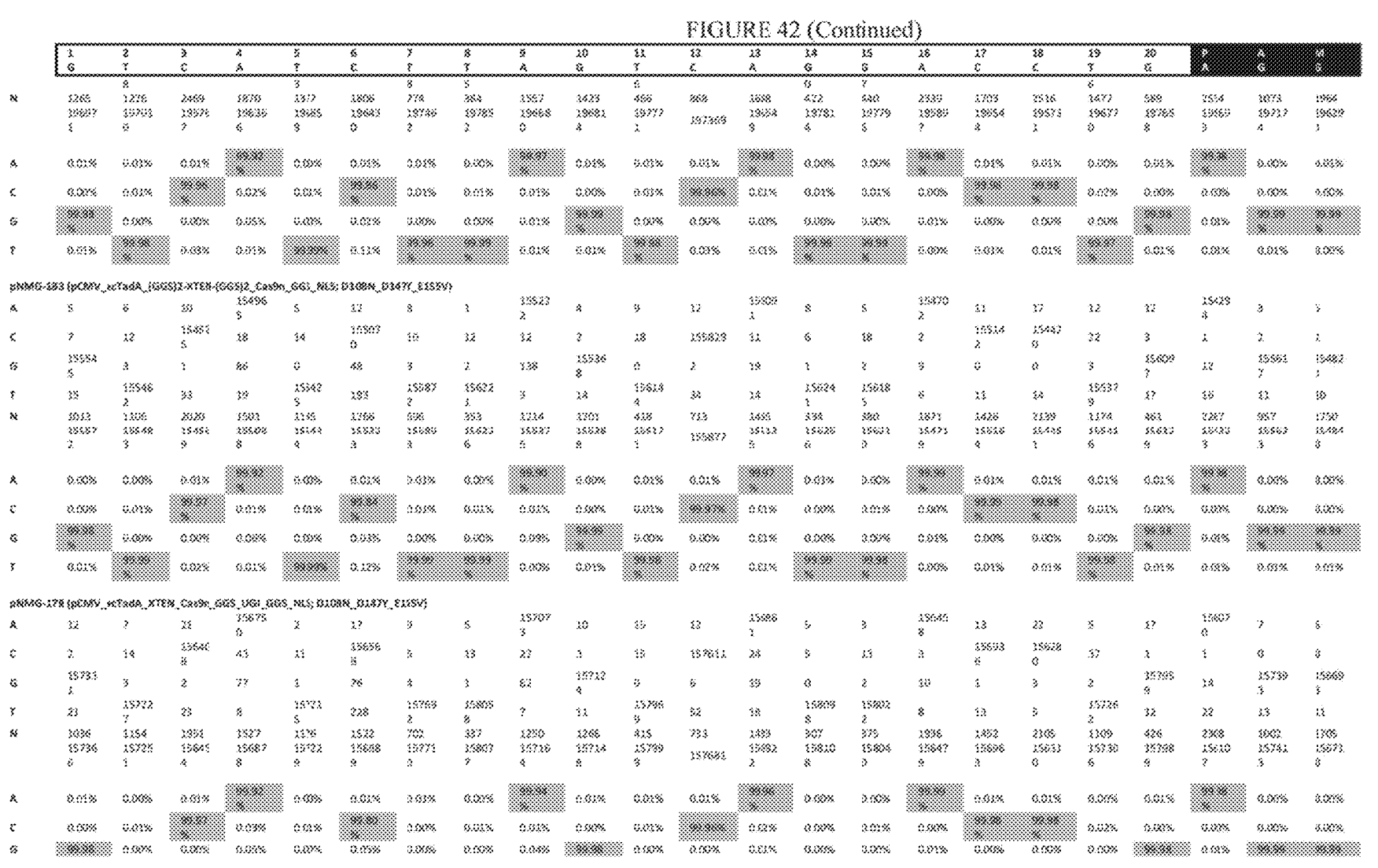
Figure 42:
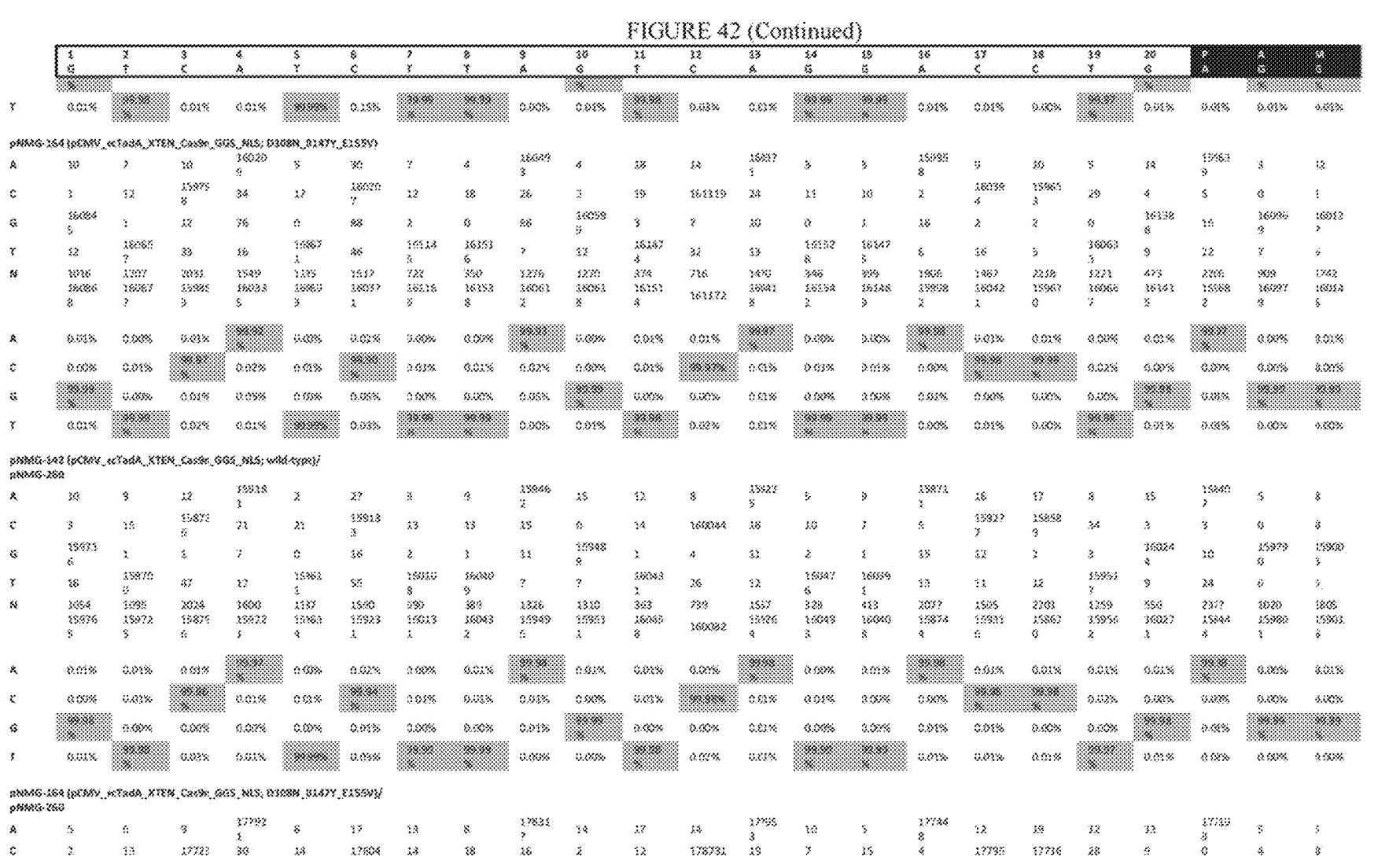
Figure 42:
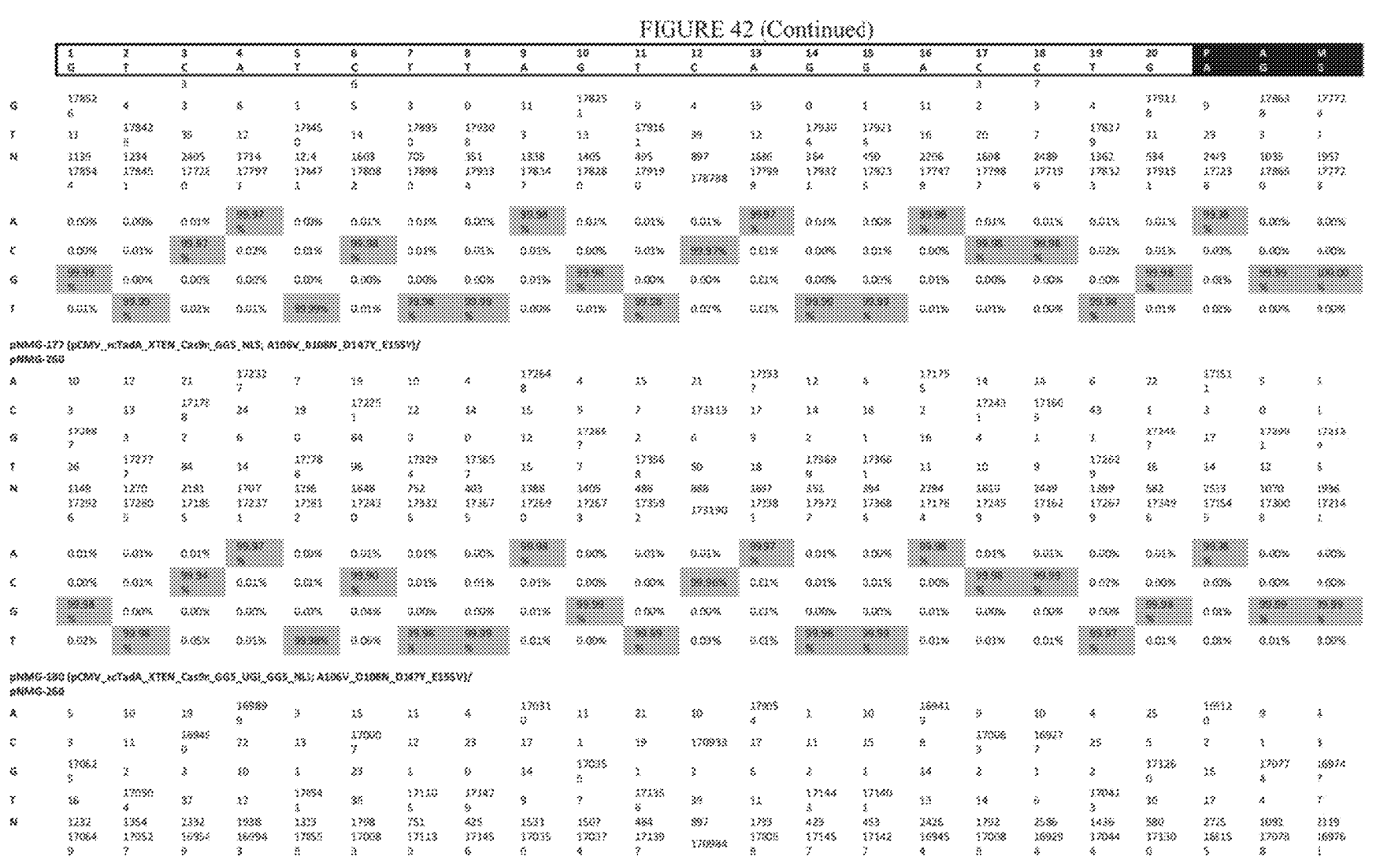
Figure 42:
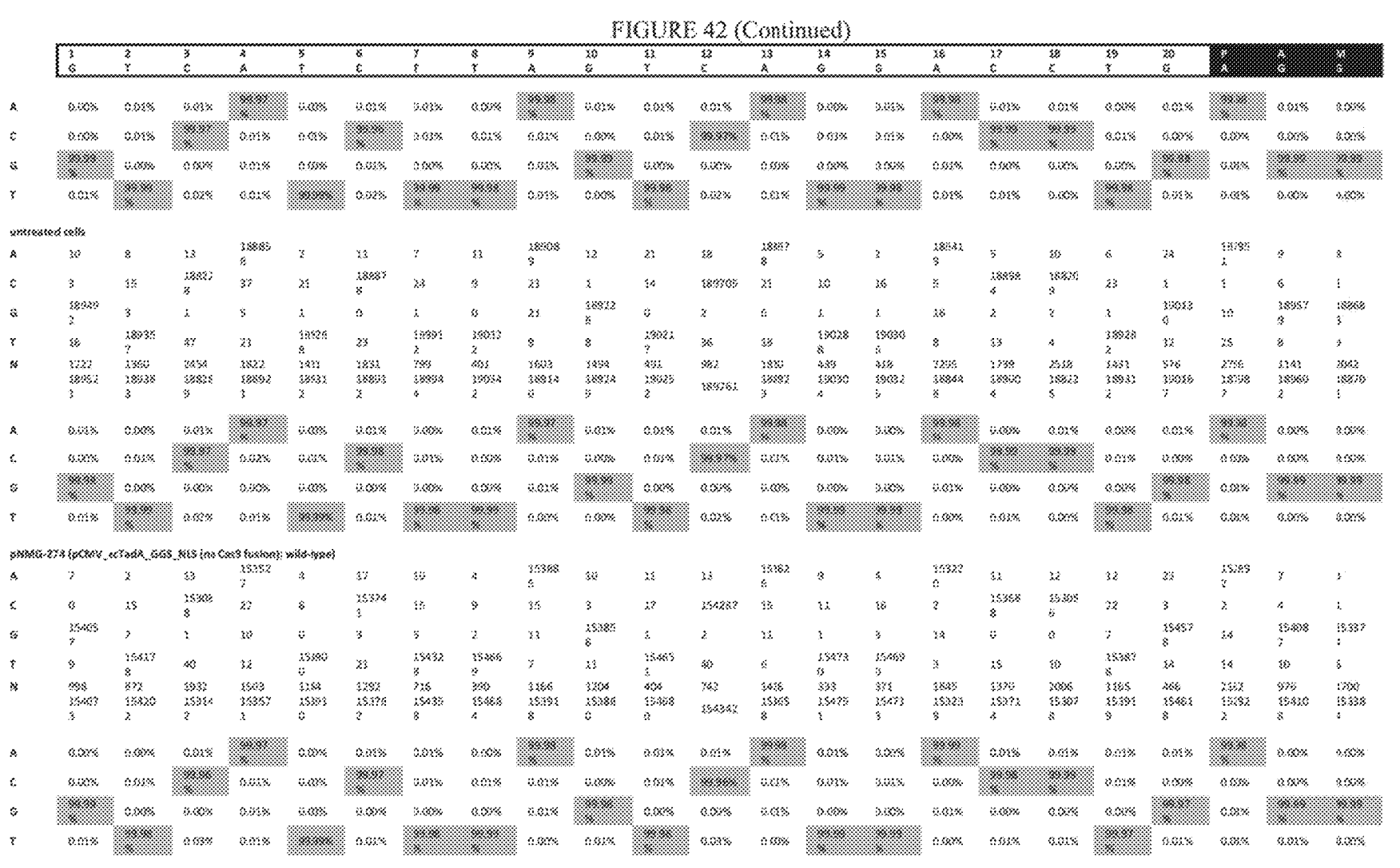
Figure 42:
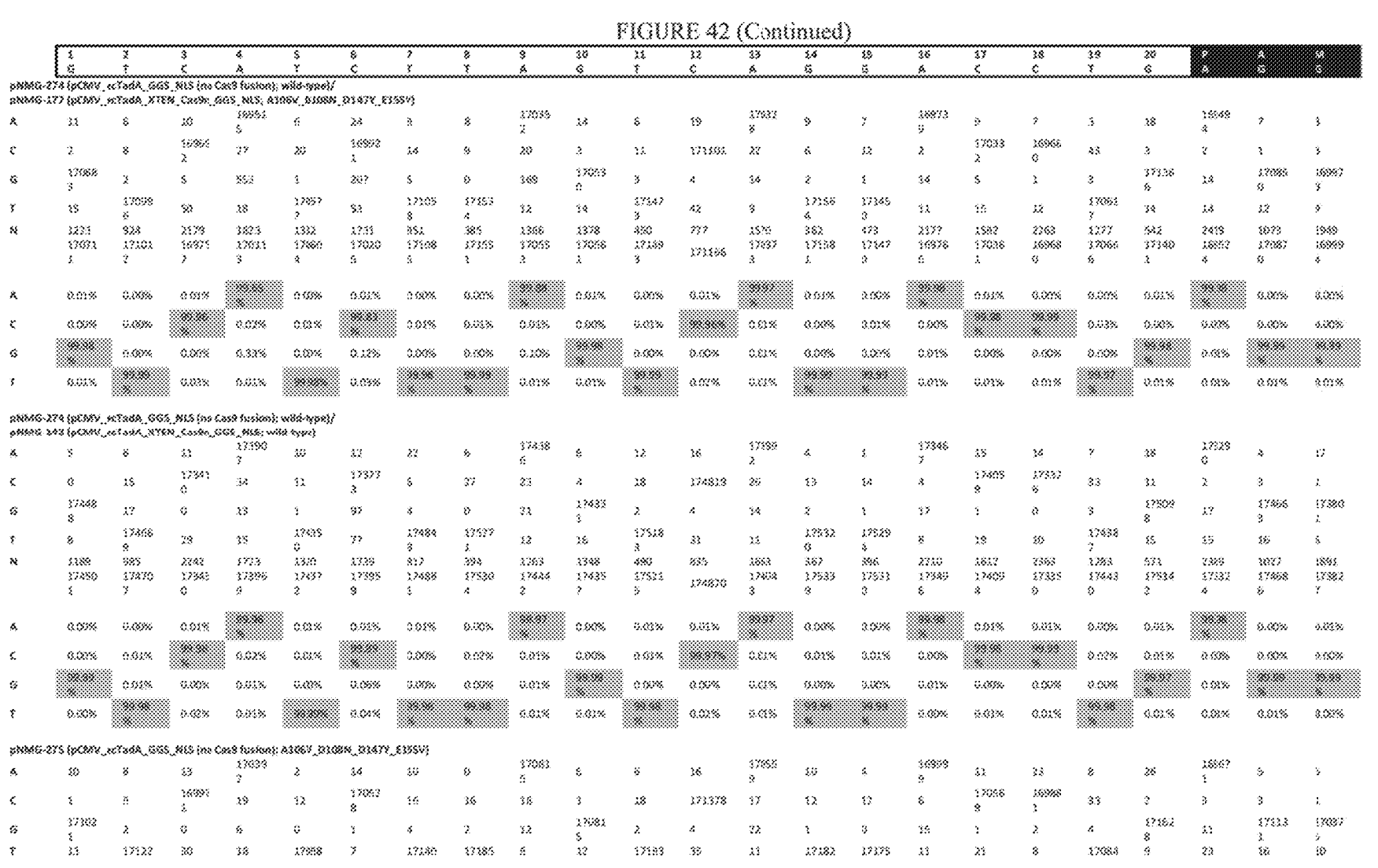
Figure 42:
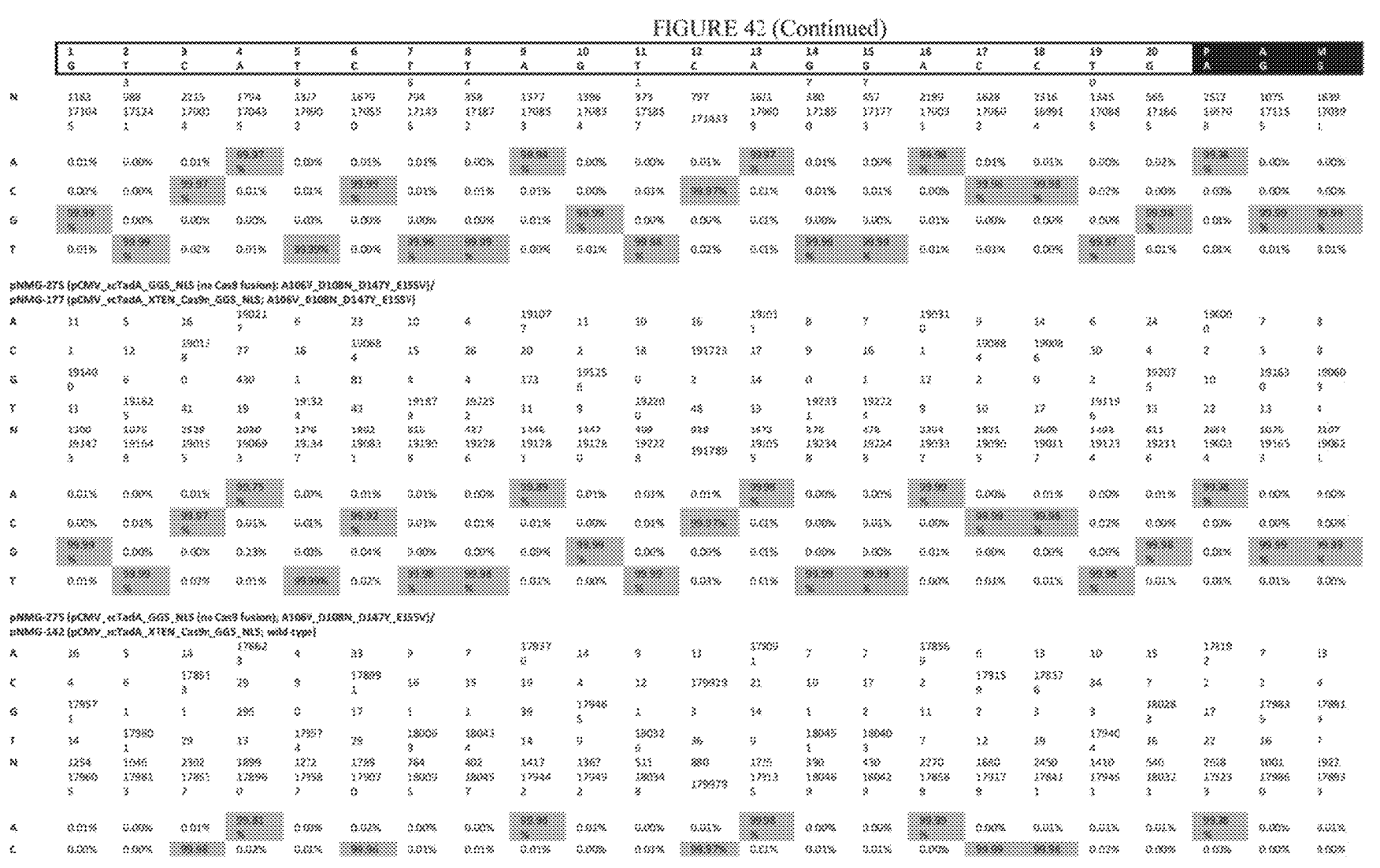
Figure 42:
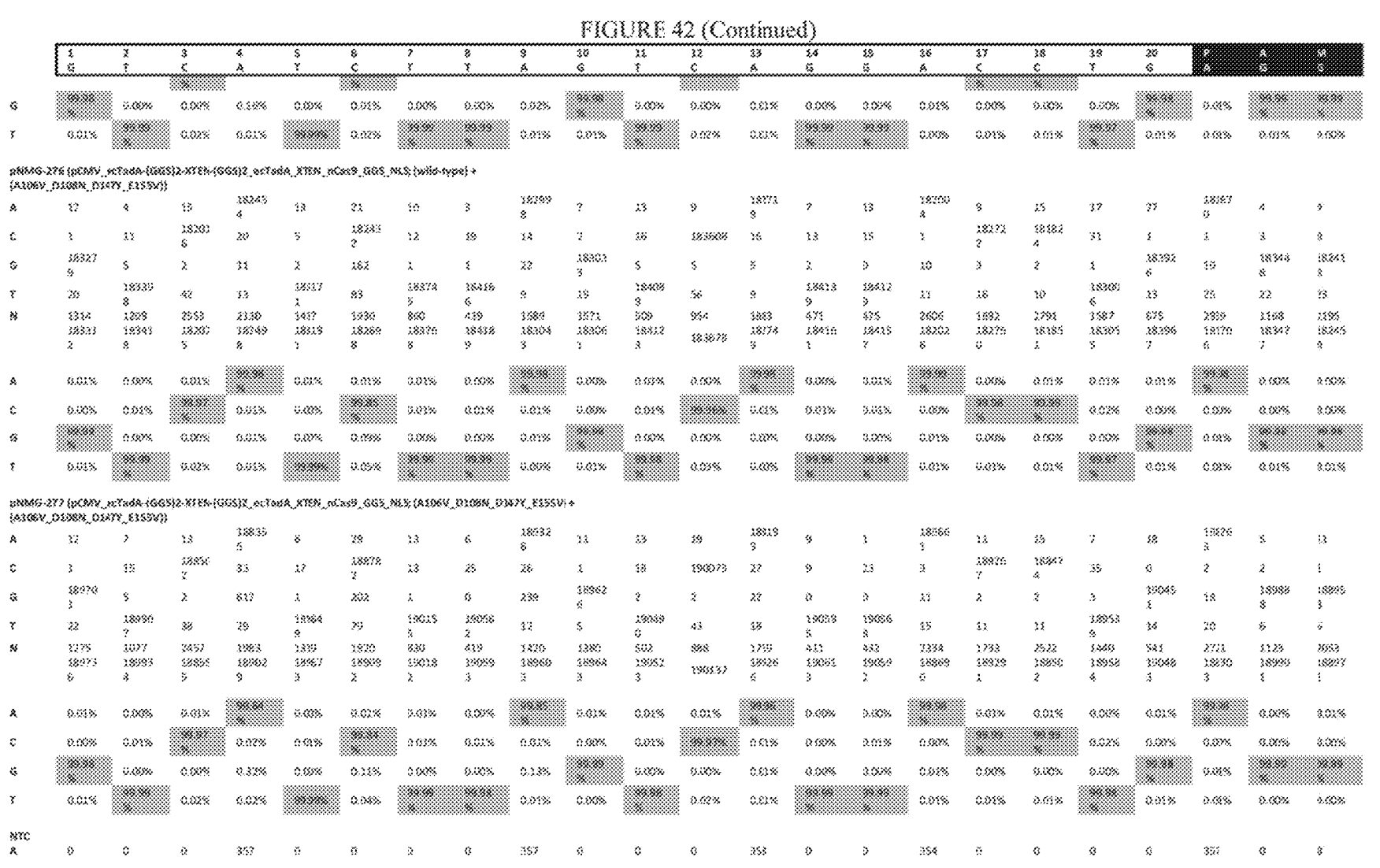
Figure 42:
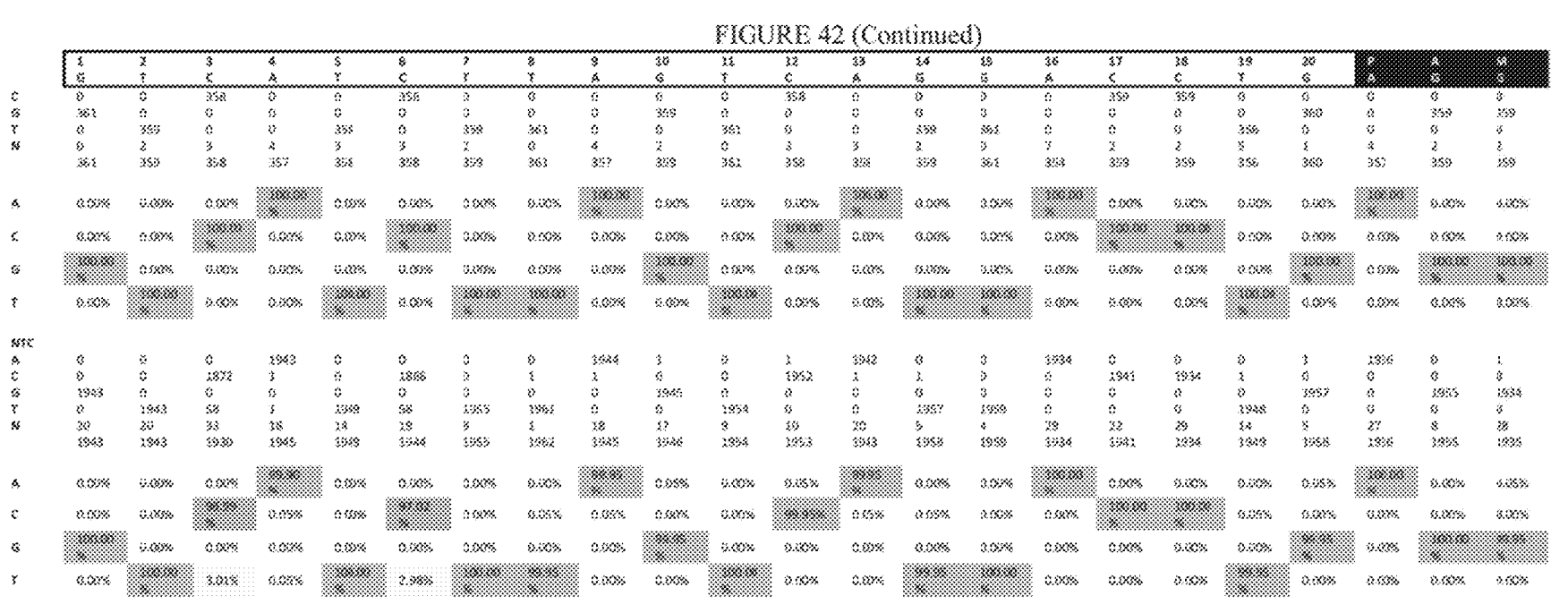

FIG. 42 shows the results of transfection at the RNF-2 site. The sequence corresponds to SEQ ID NO: 44.

Figure 43:
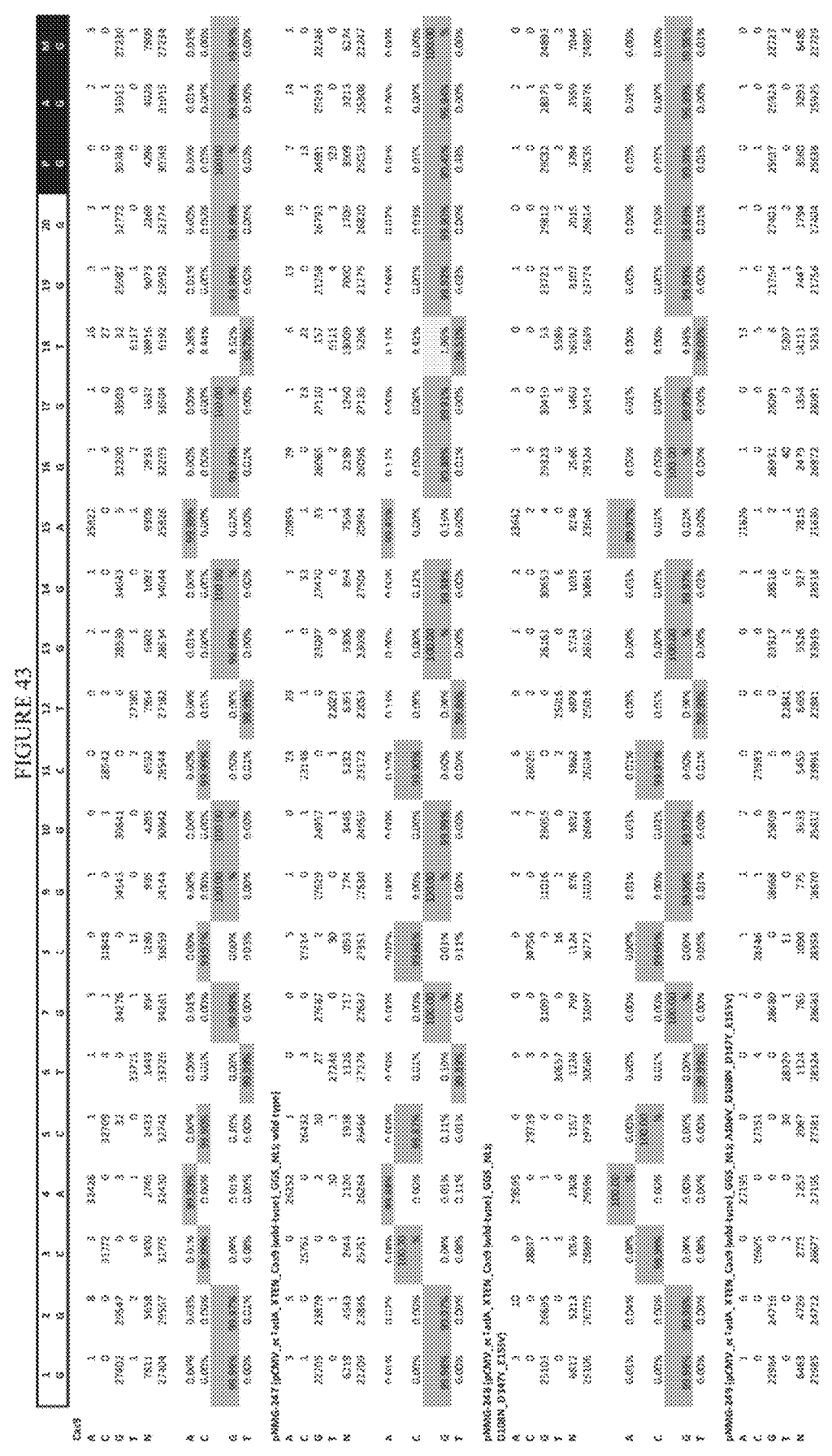
Figure 43:
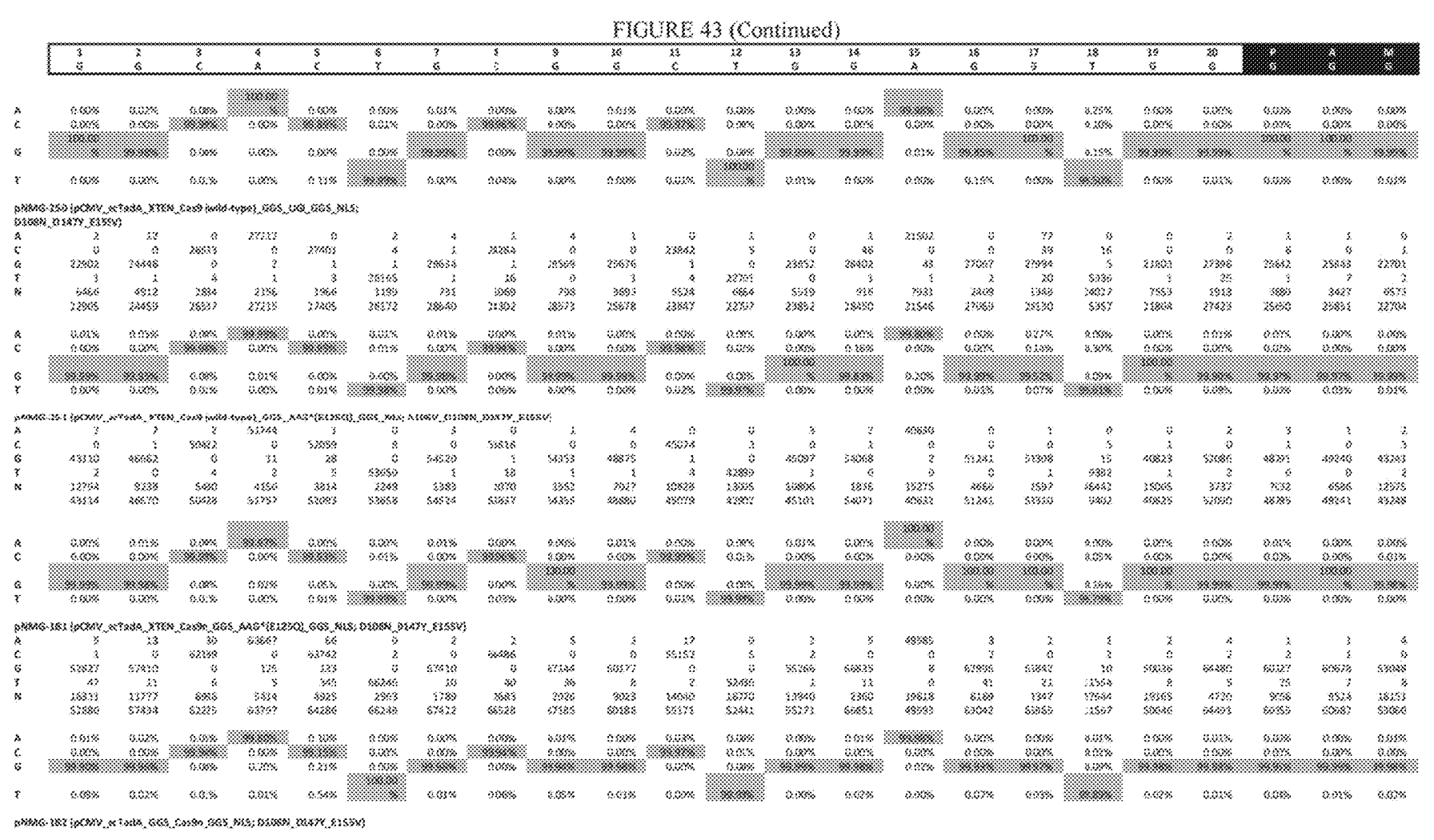
Figure 43:
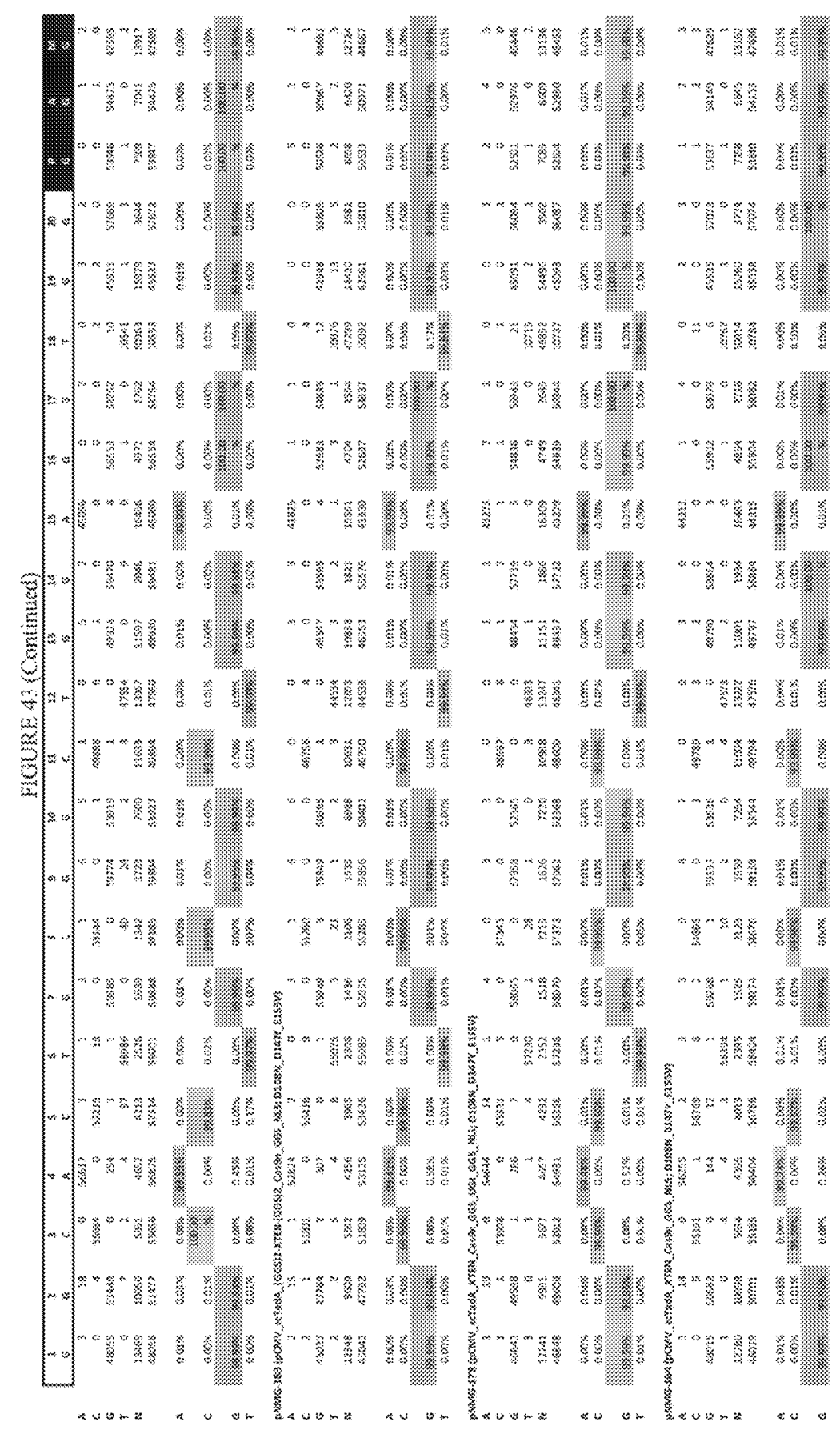
Figure 43:
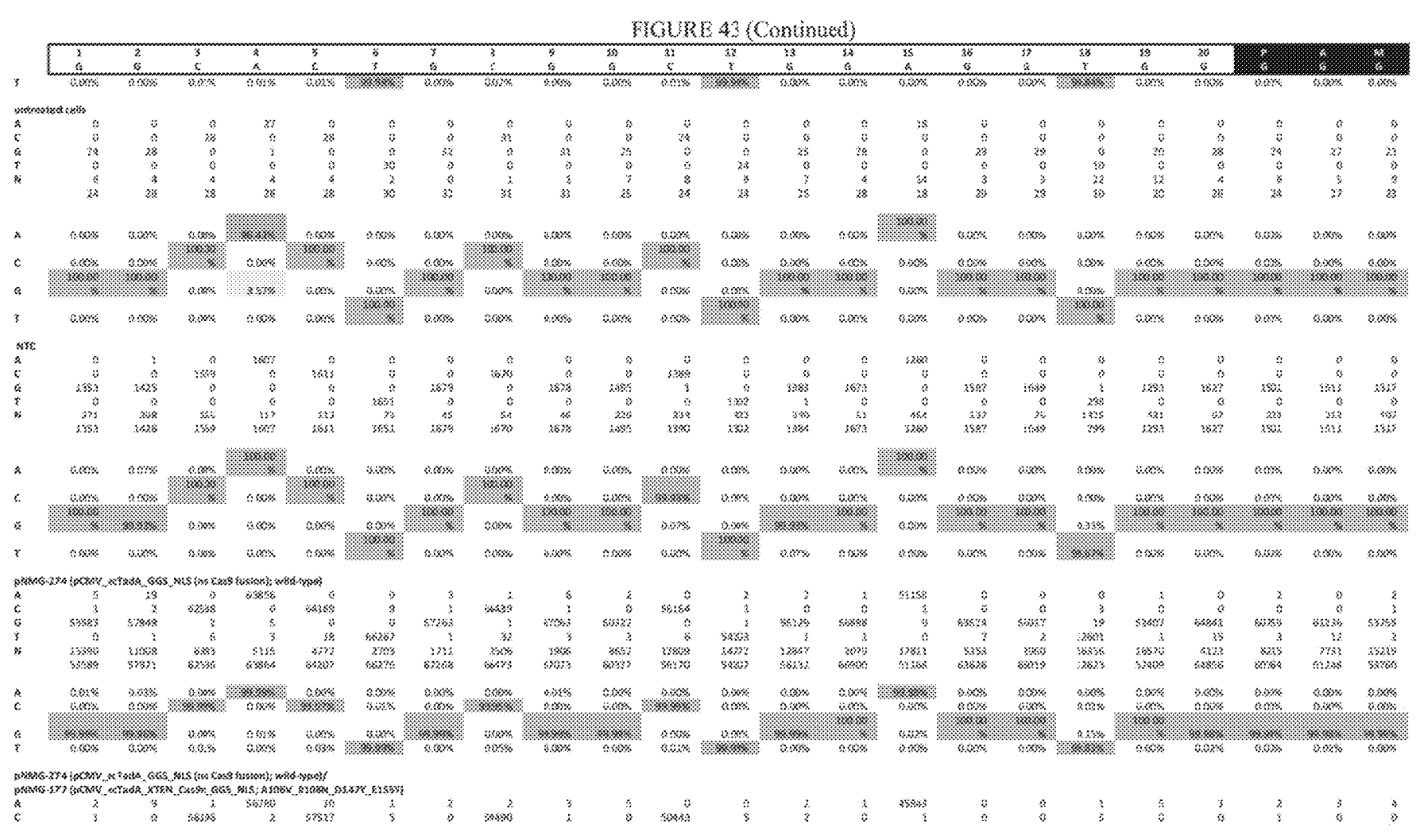
Figure 43:
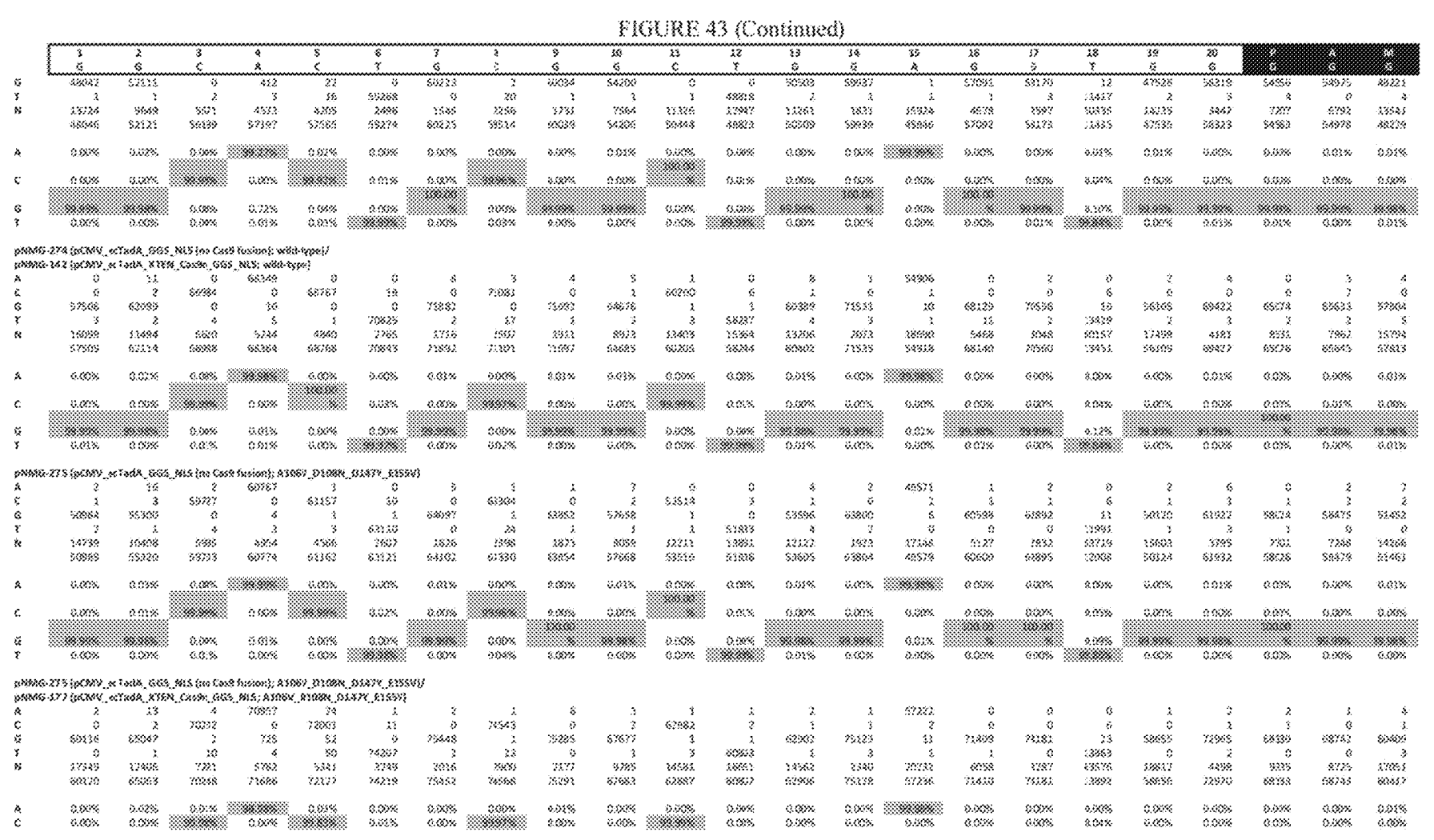
Figure 43:
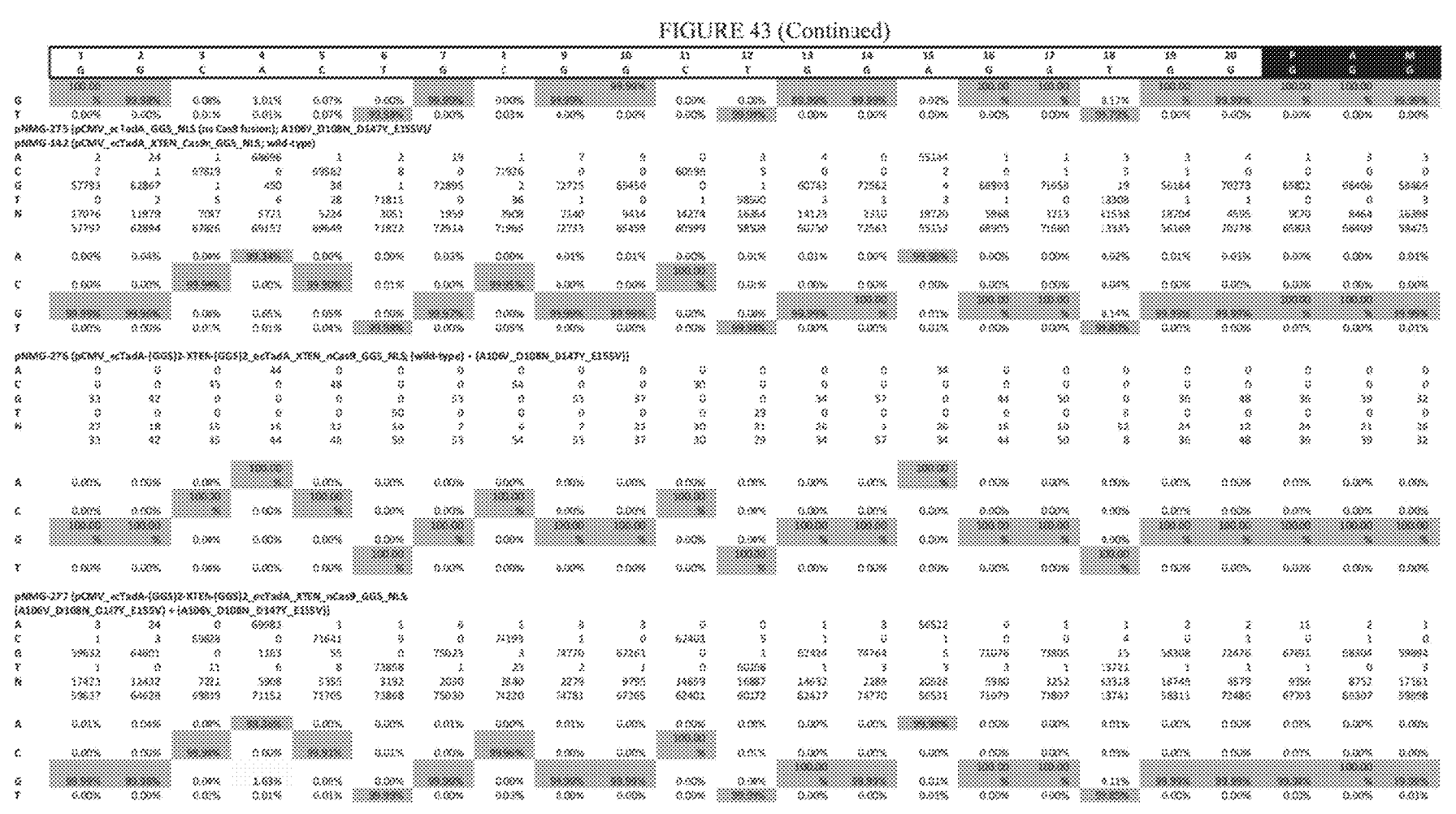

FIG. 43 shows the results of transfection at the Hek-4 site. The sequence corresponds to SEQ ID NO: 43.

Figure 44:
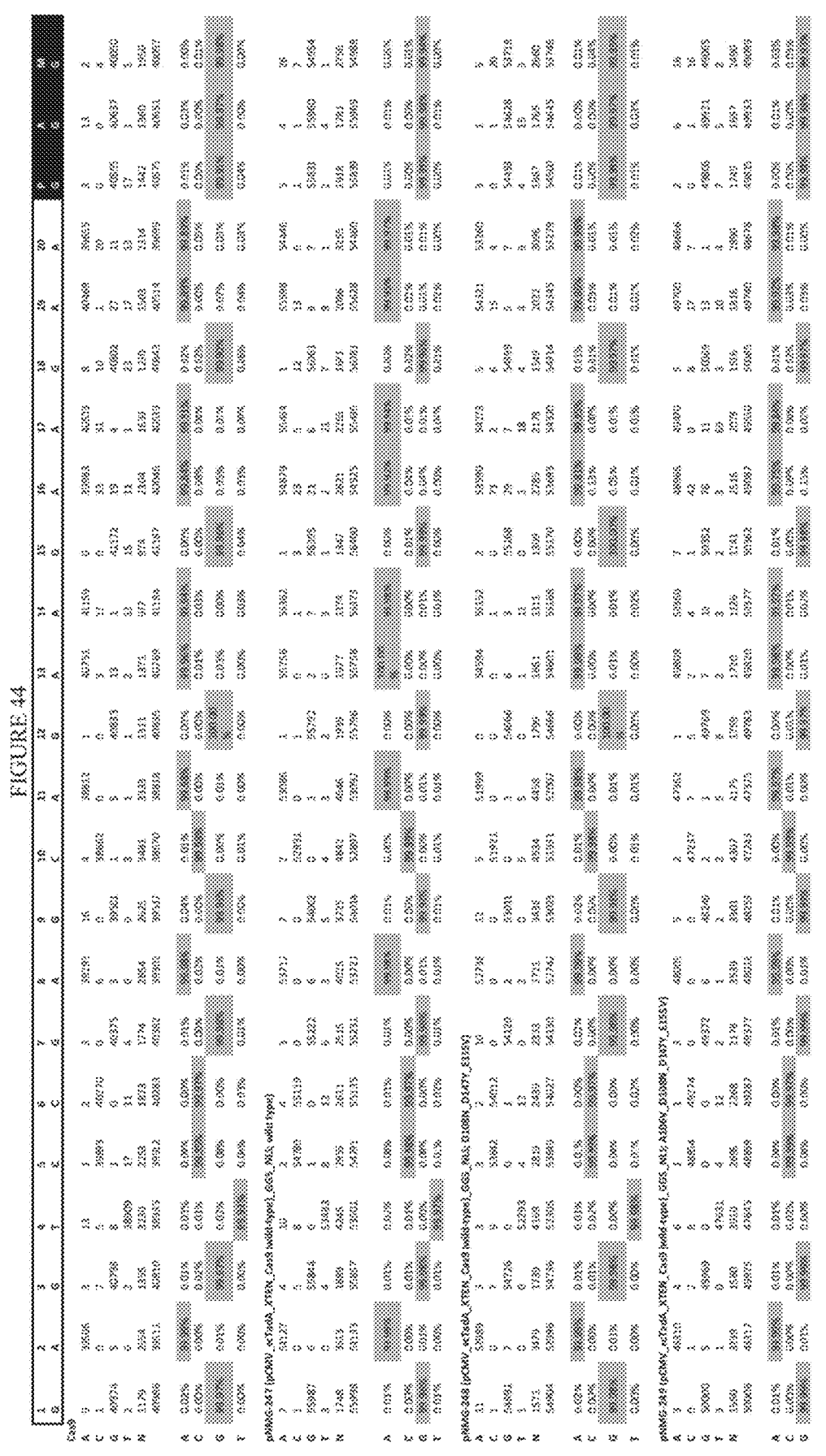
Figure 44:
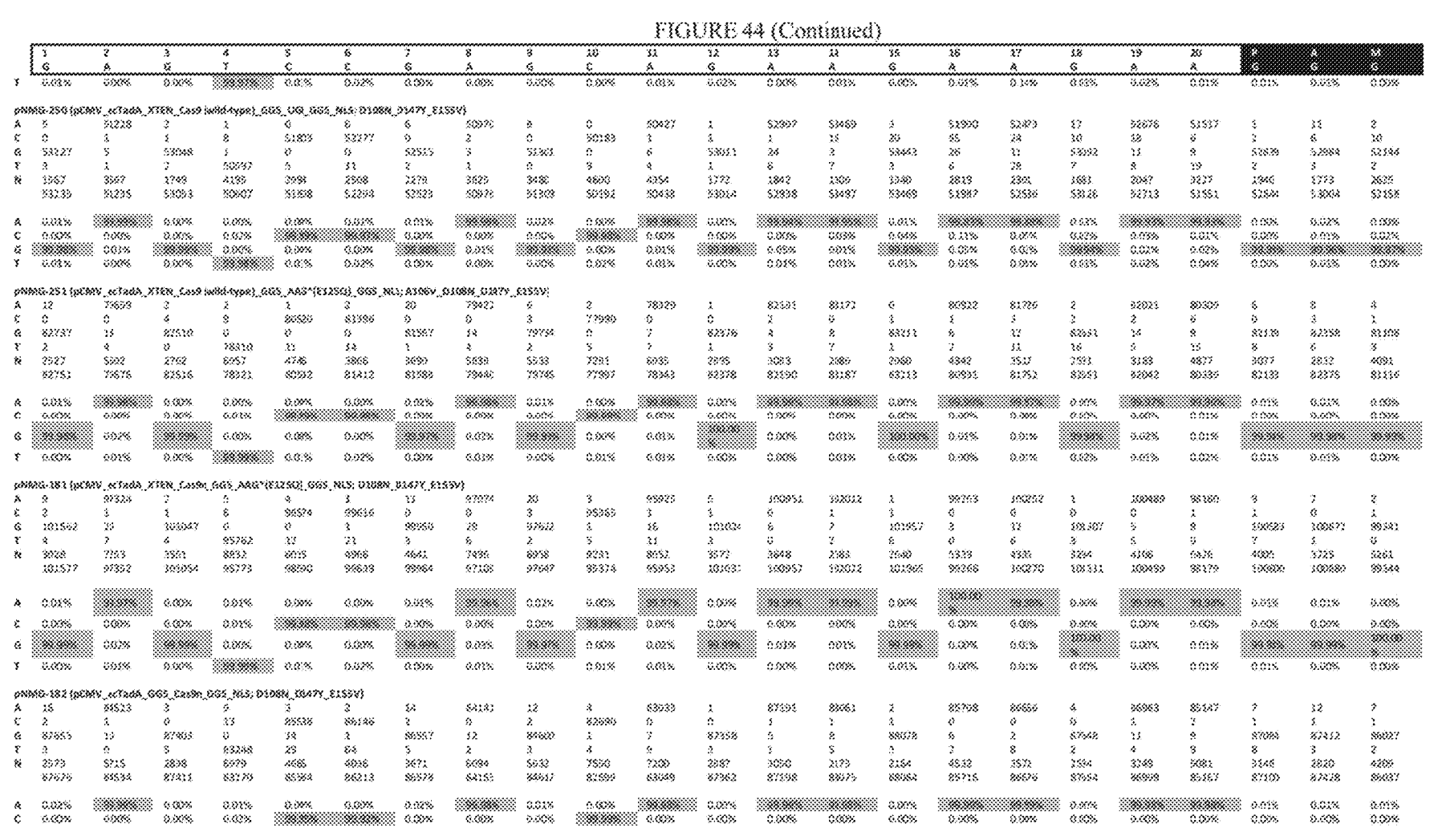
Figure 44:
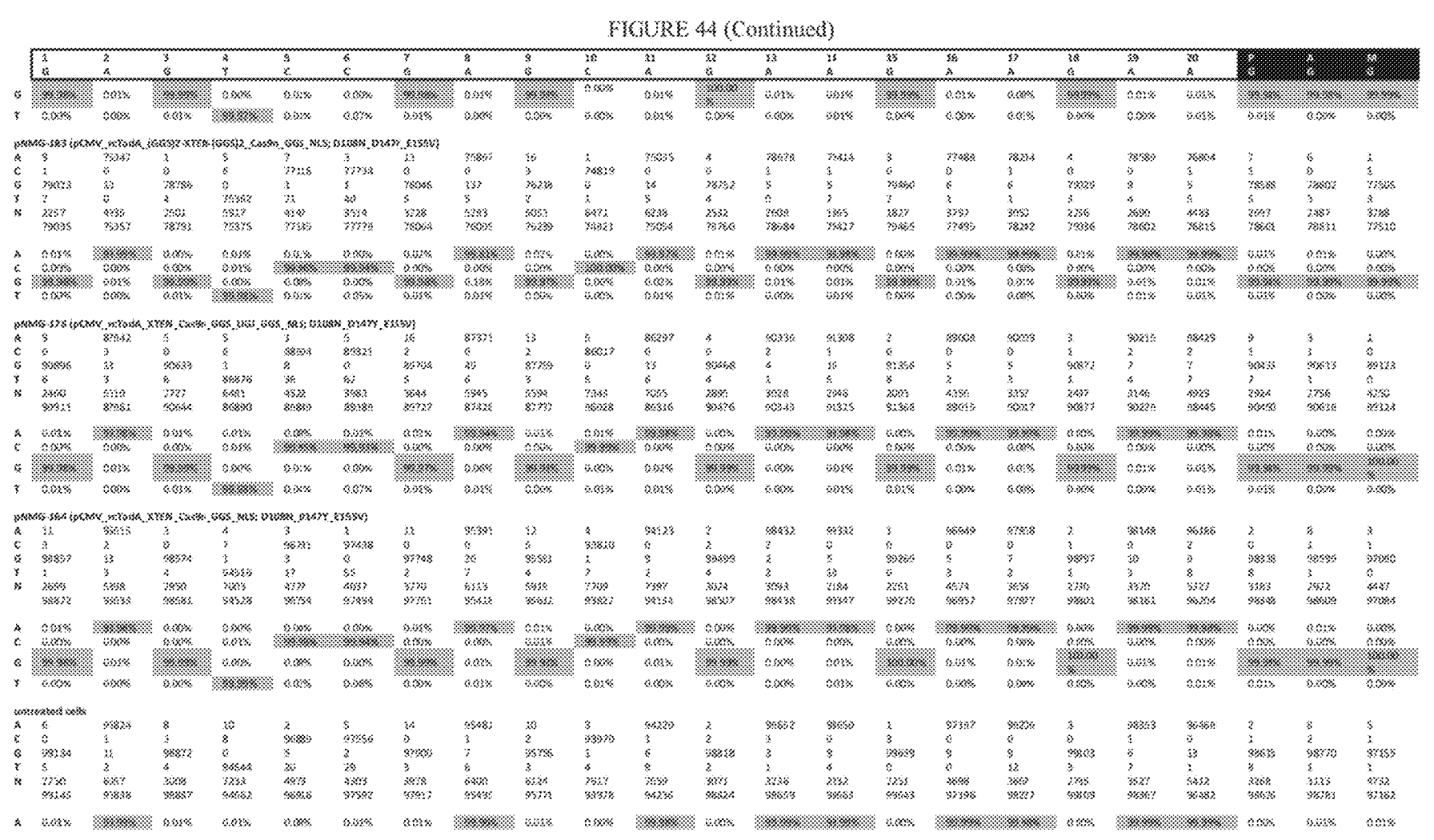
Figure 44:
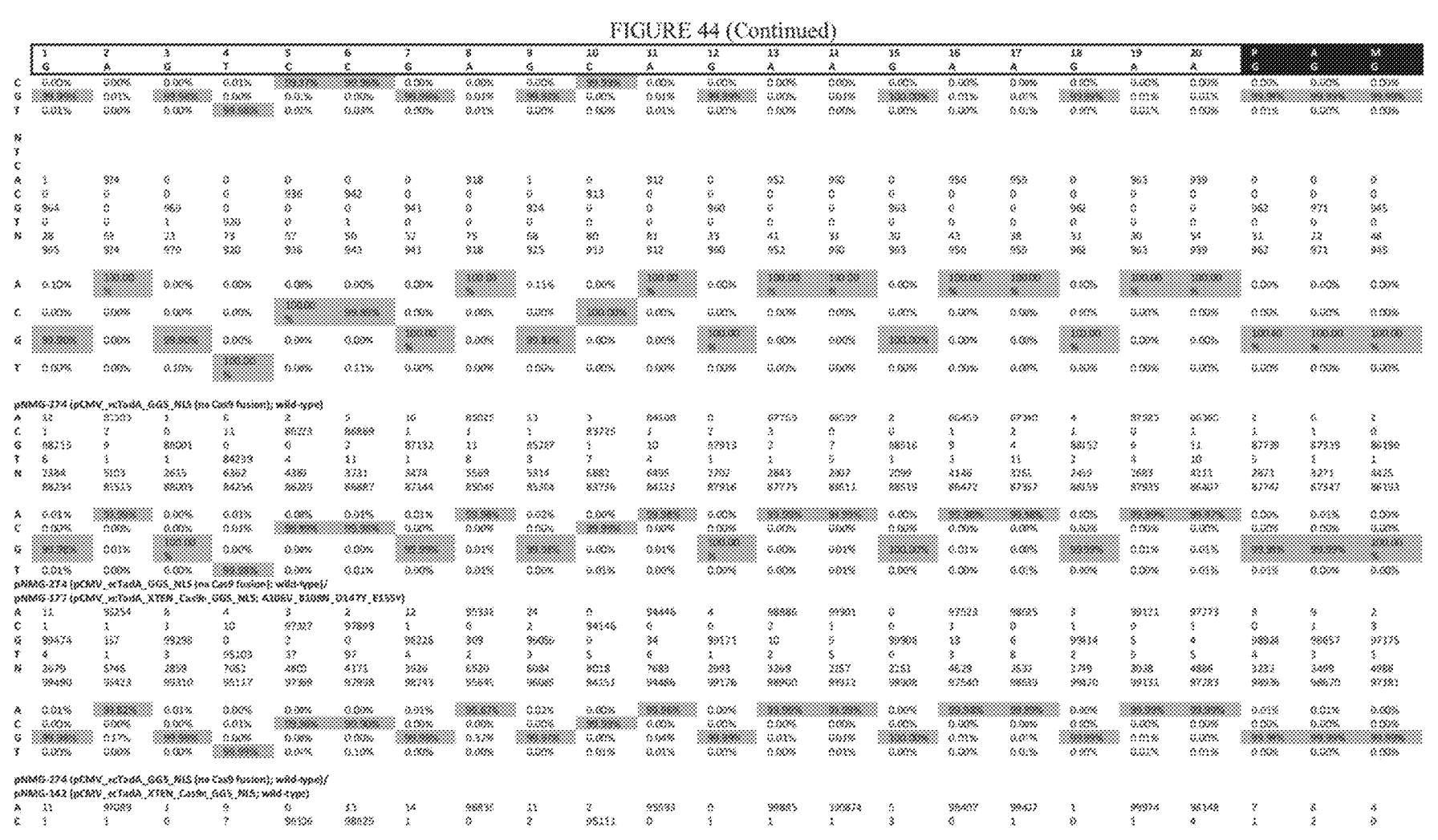
Figure 44:
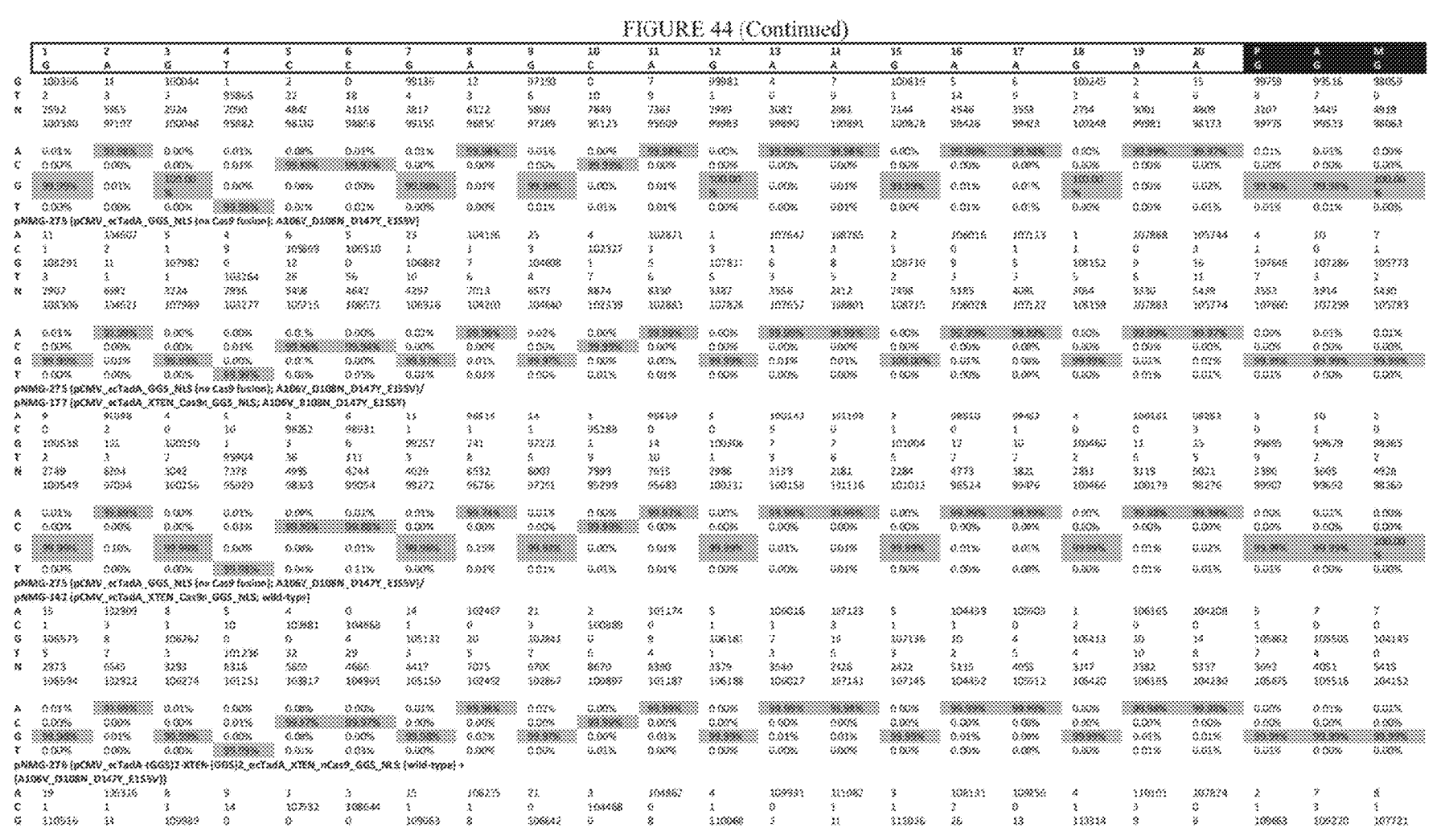
Figure 44:
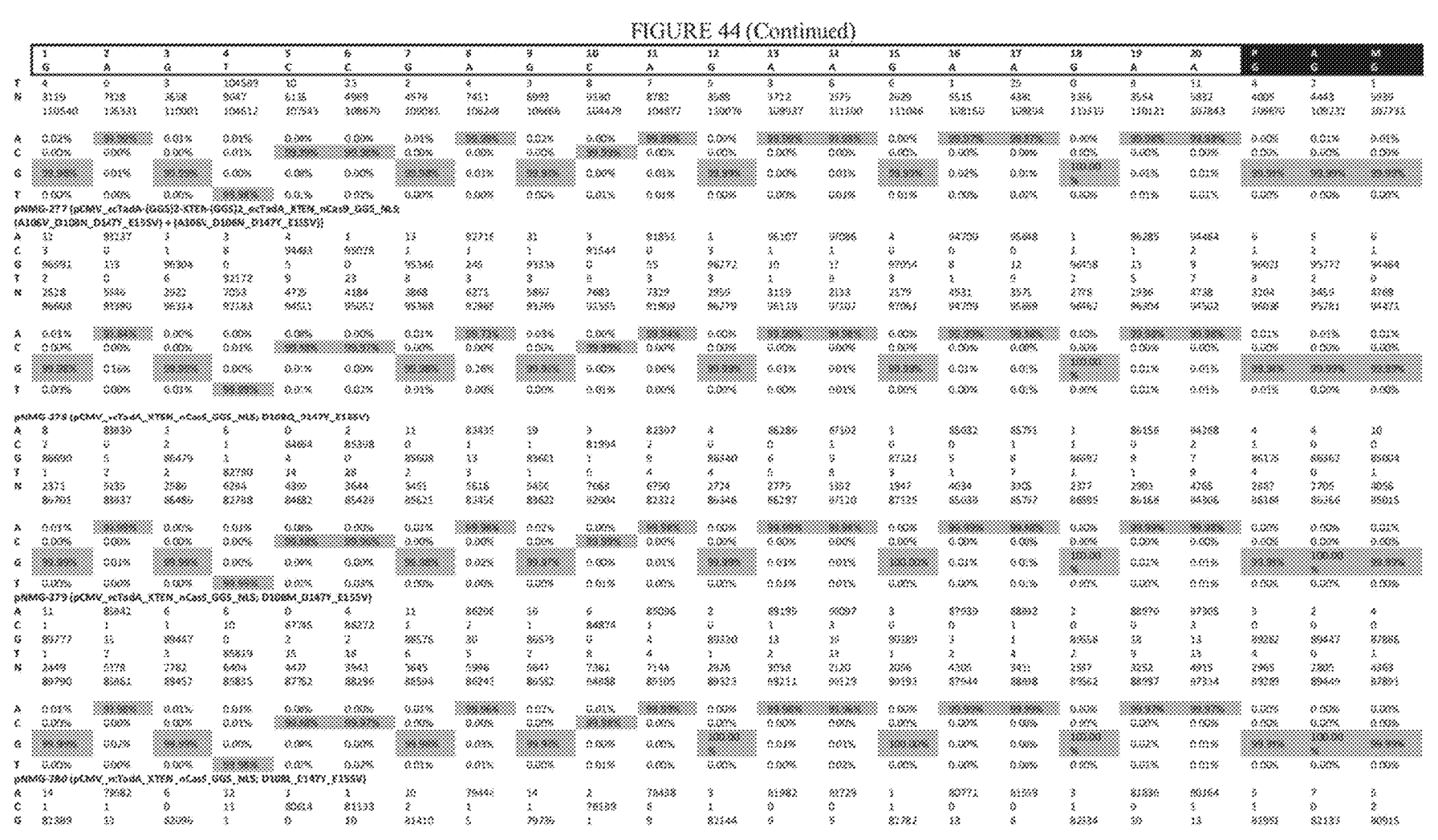
Figure 44:
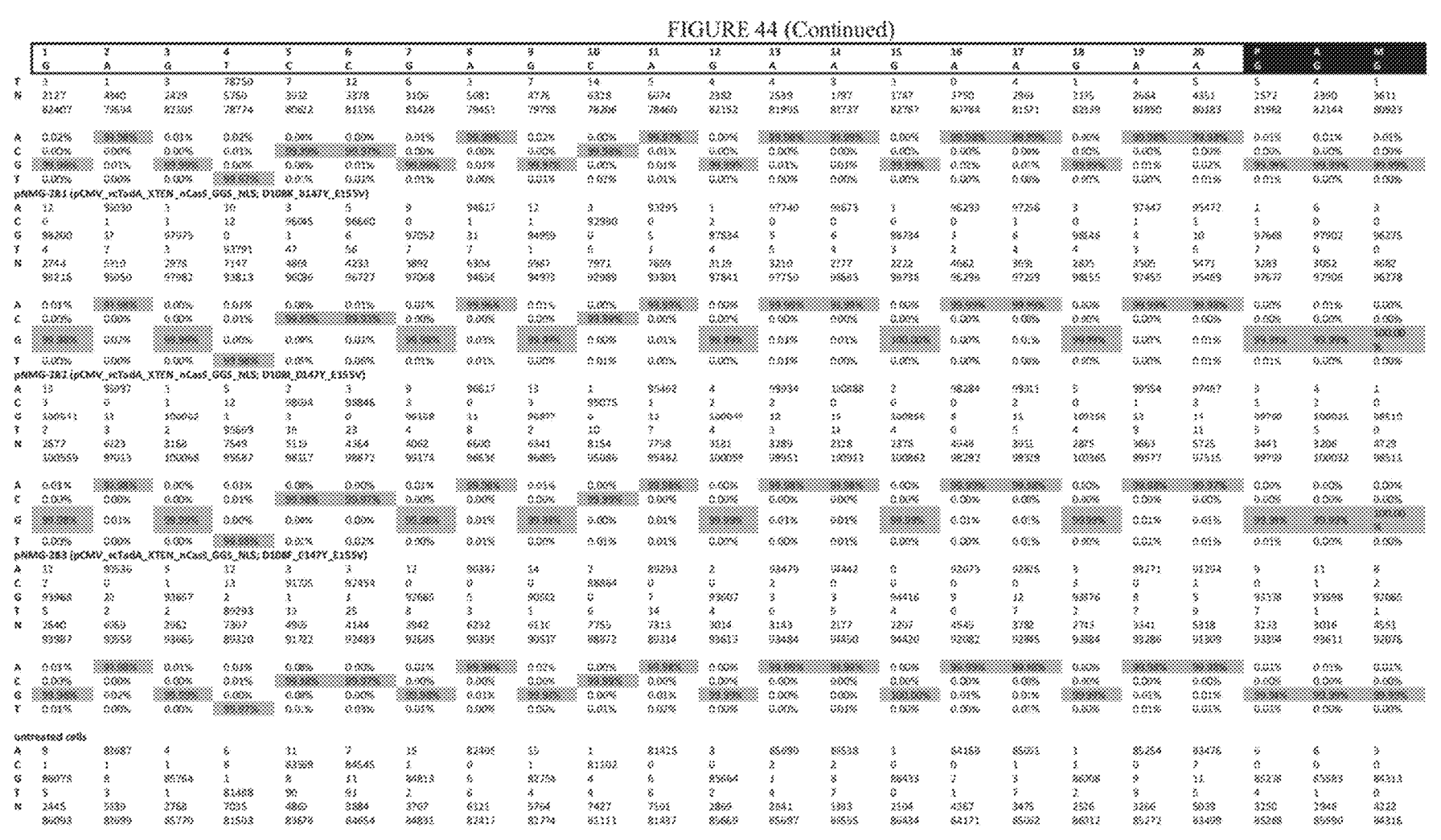
Figure 44:
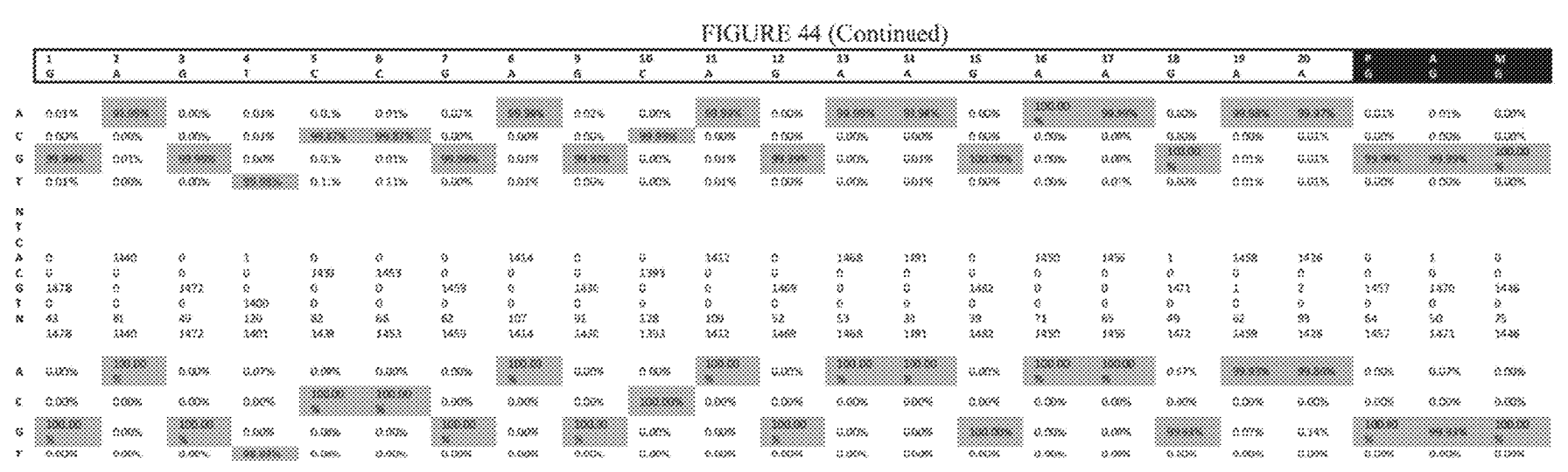

FIG. 44 shows the results of transfection at the EMX-1 site. The sequence corresponds to SEQ ID NO: 46.

Figure 45:
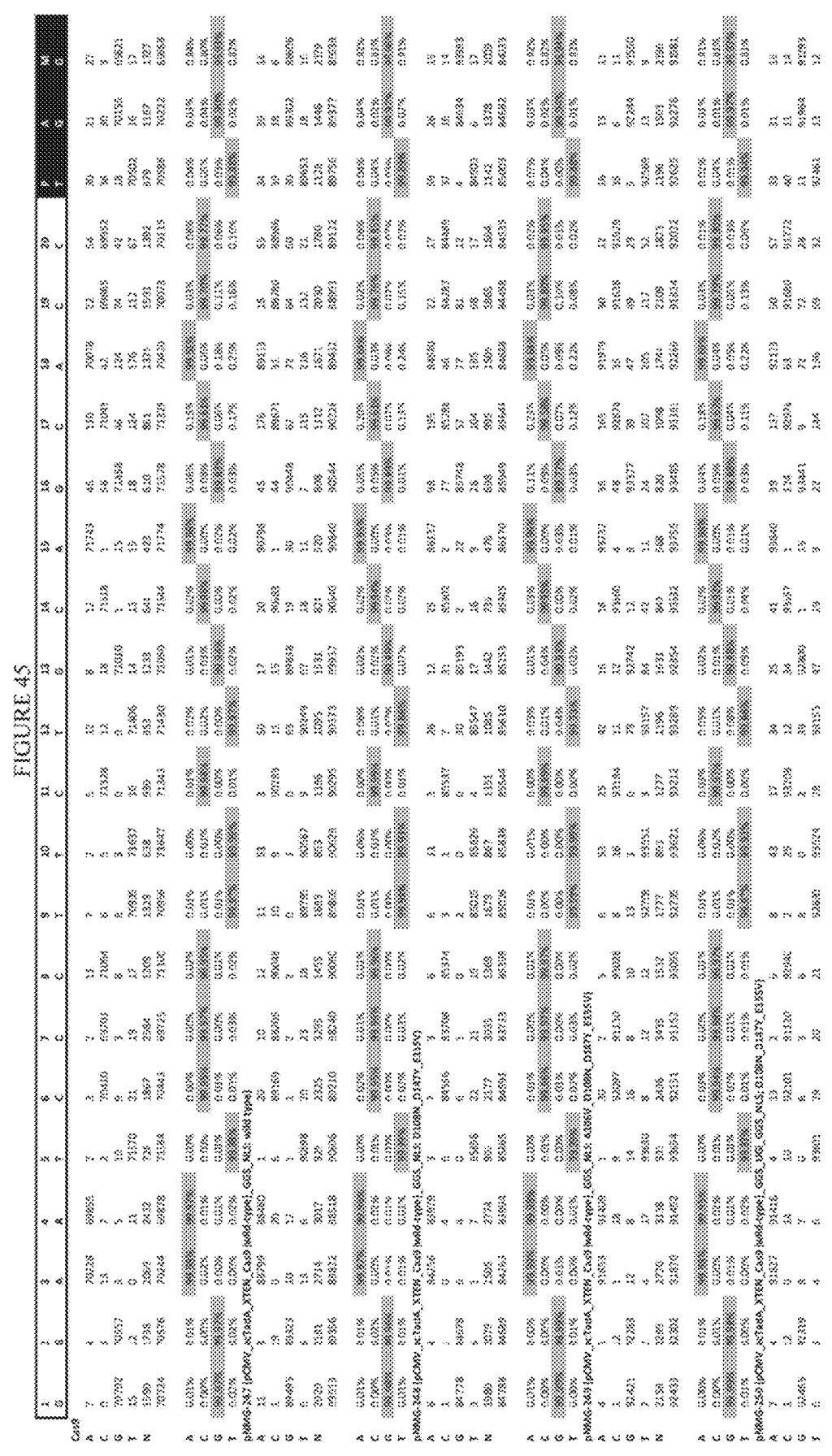
Figure 45:
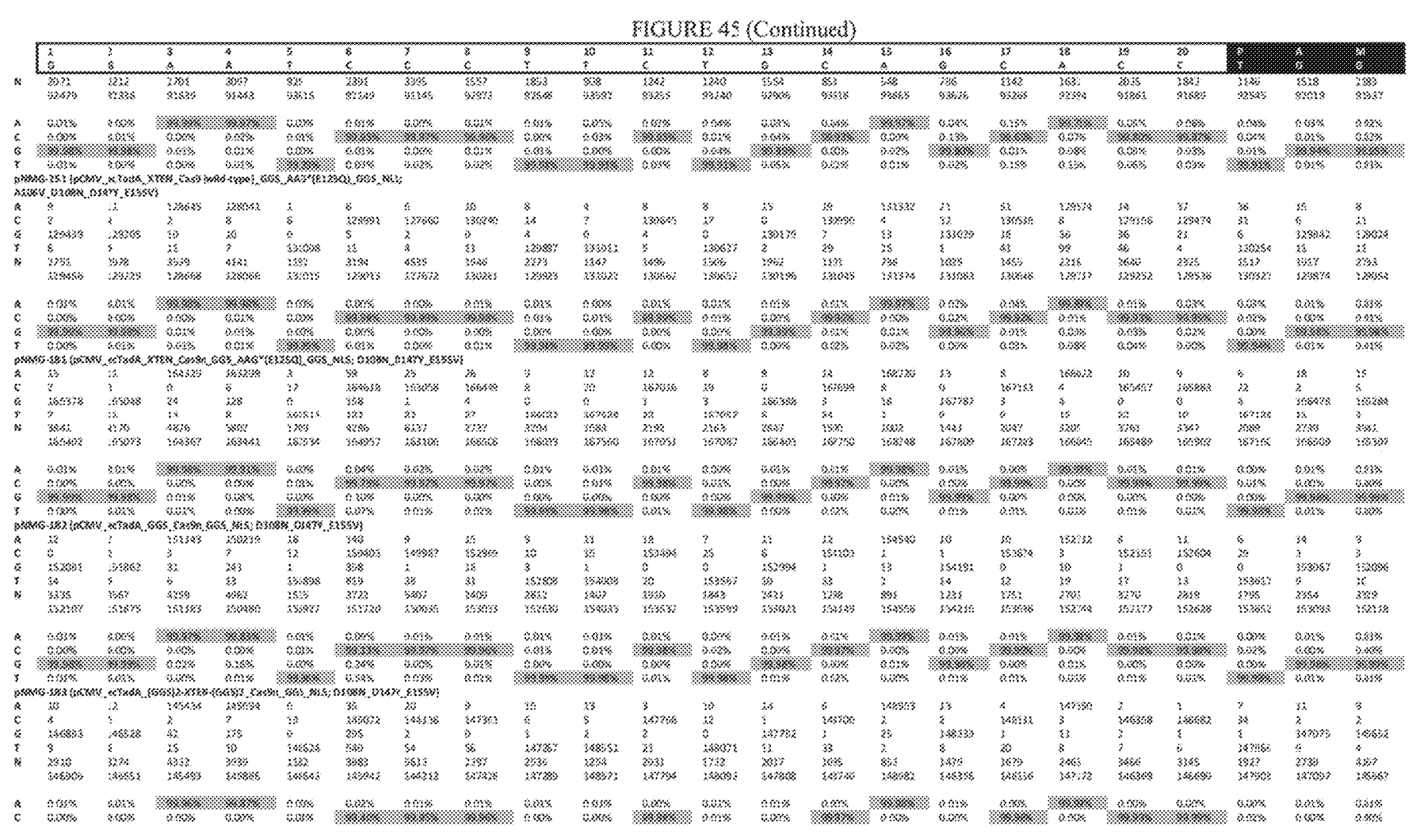
Figure 45:
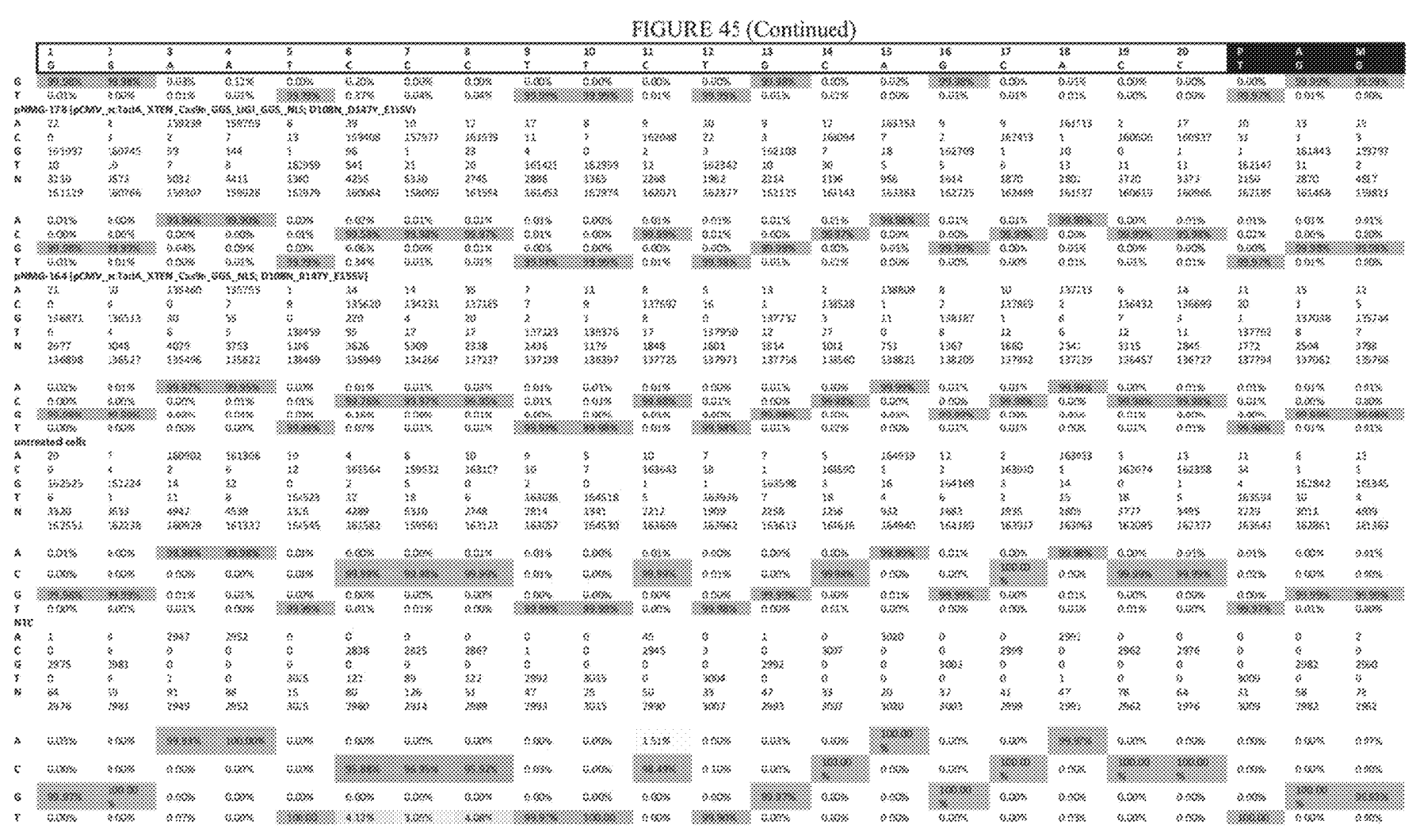
Figure 45:
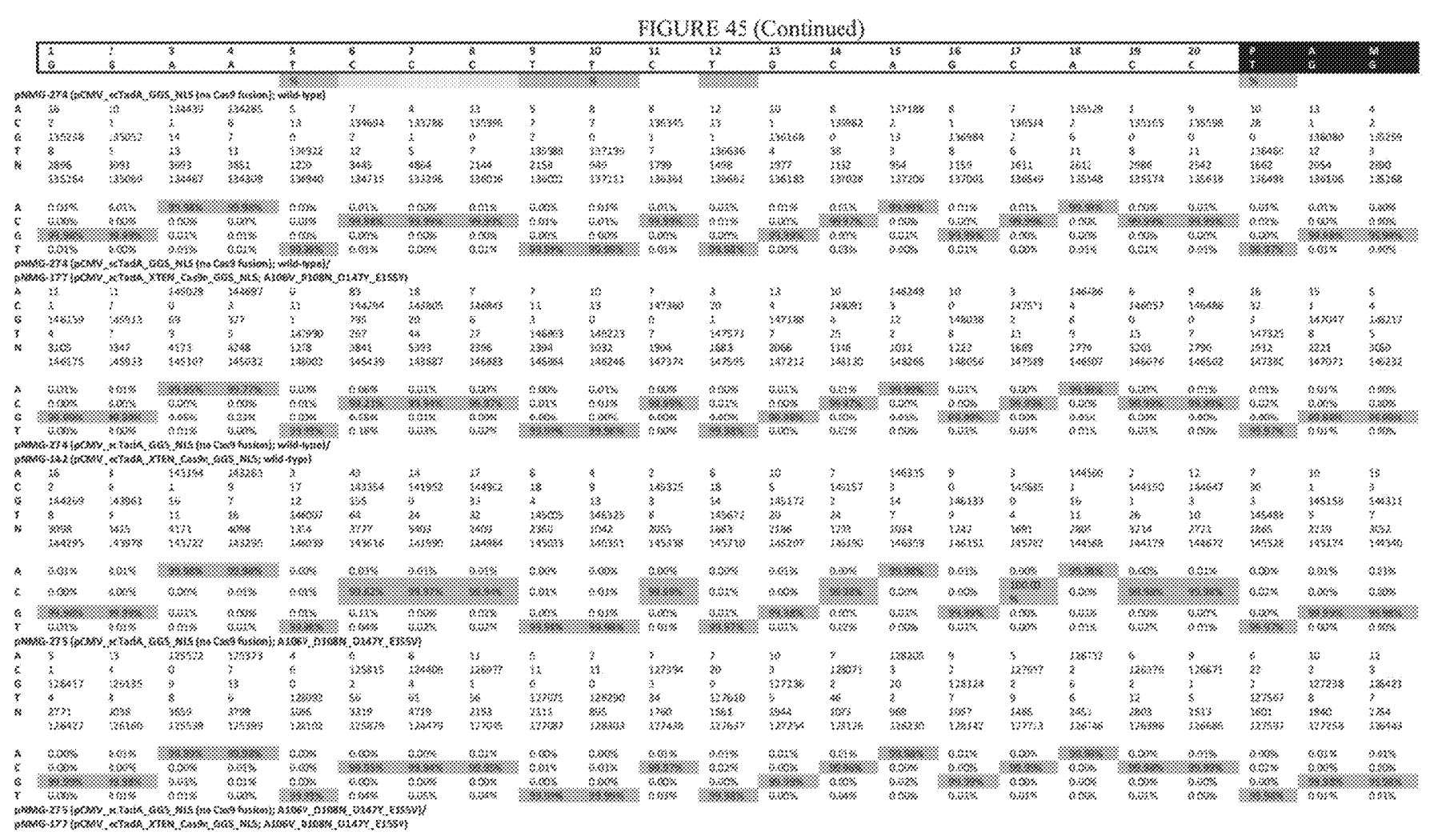
Figure 45:
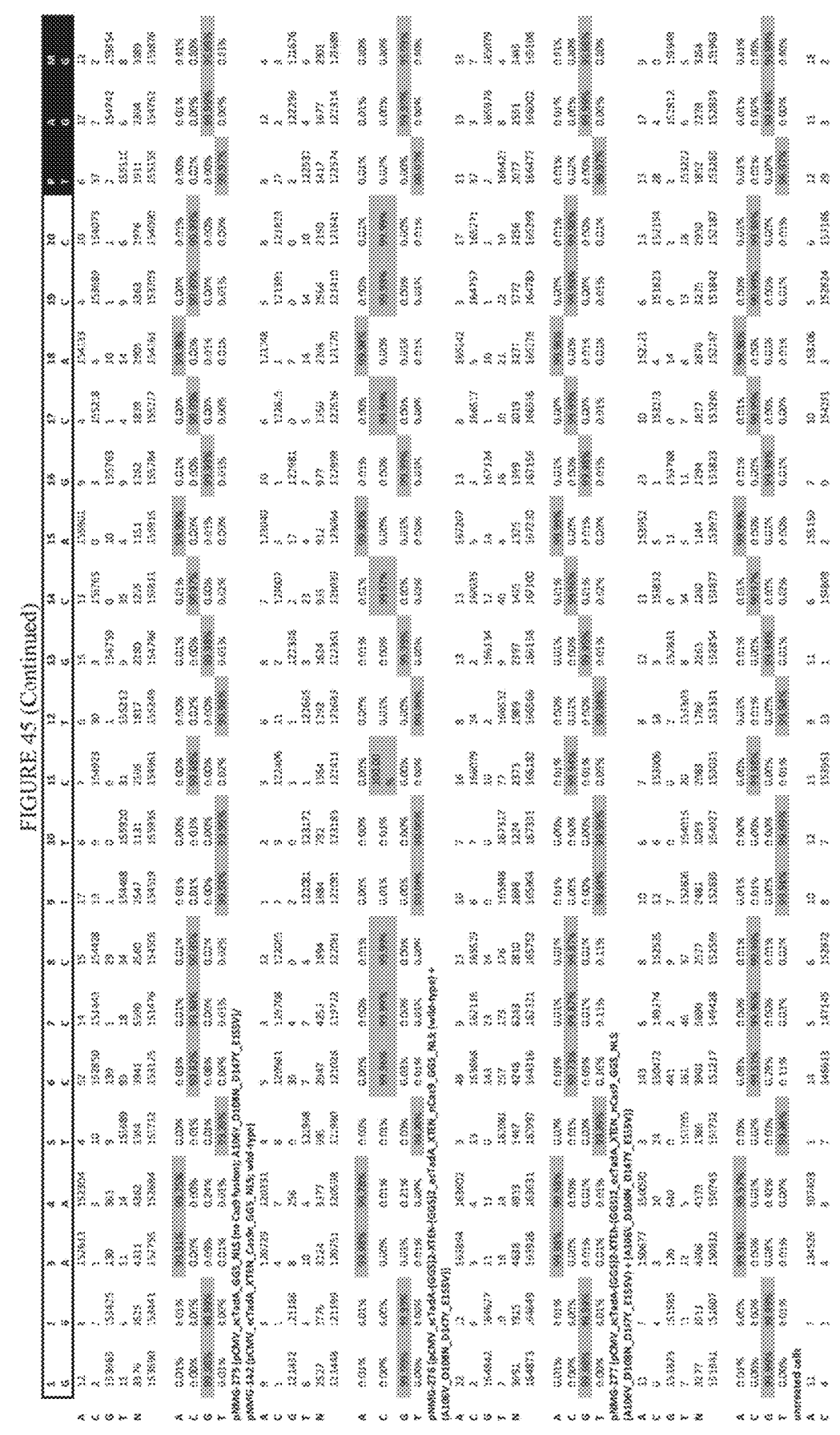
Figure 45:
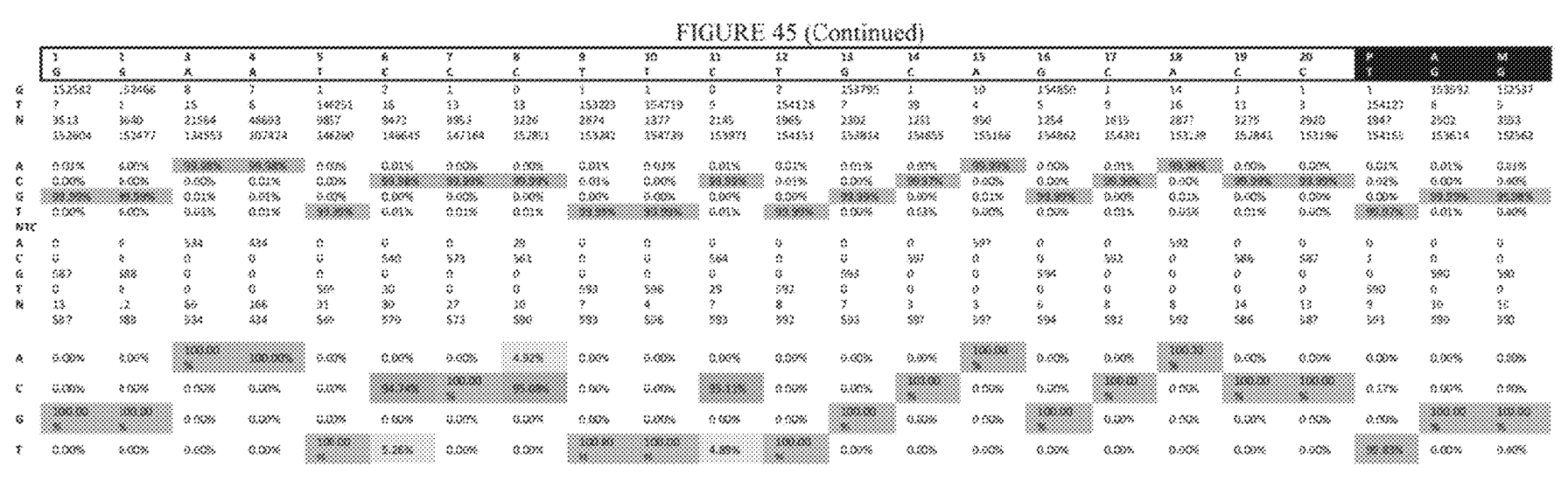

FIG. 45 shows the results of transfection at the FANCF site. The sequence corresponds to SEQ ID NO: 45.

Figure 46:
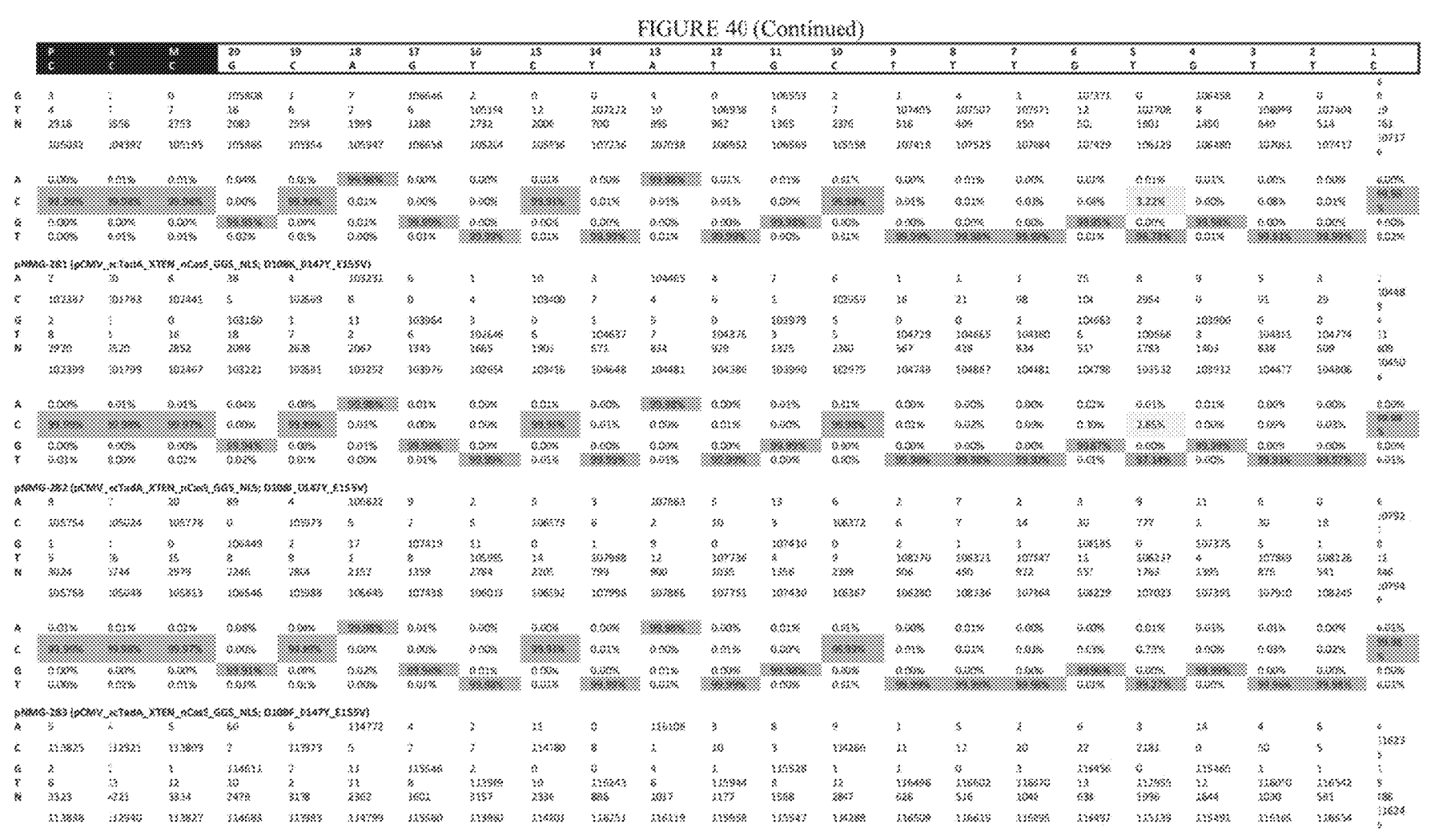

FIG. 46 shows deaminase editing of sgRNA.

FIG. 47 shows constructs developed for fusions at various sites.

FIG. 48 shows indel rates for different fusions at various sites.

FIG. 49 shows the protospacer and PAM sequences of base editing sites set forth in SEQ ID NOs: 46, 45, 6, 42, 43, and 468 from top to bottom, respectively.

FIG. 59 shows the importance of linker length on base editing function.

FIG. 60 shows the importance of linker length on base editing function.

FIG. 64 shows dimerization results from base editing.

FIG. 65 shows dimerization results from base editing.

FIG. 71 shows a HEK293 site 2 sequence. The sequence corresponds to SEQ ID NO: 360.

FIG. 72 shows the results of the first run with various edTadA mutations using the sequence of FIG. 71.

Figure 73:
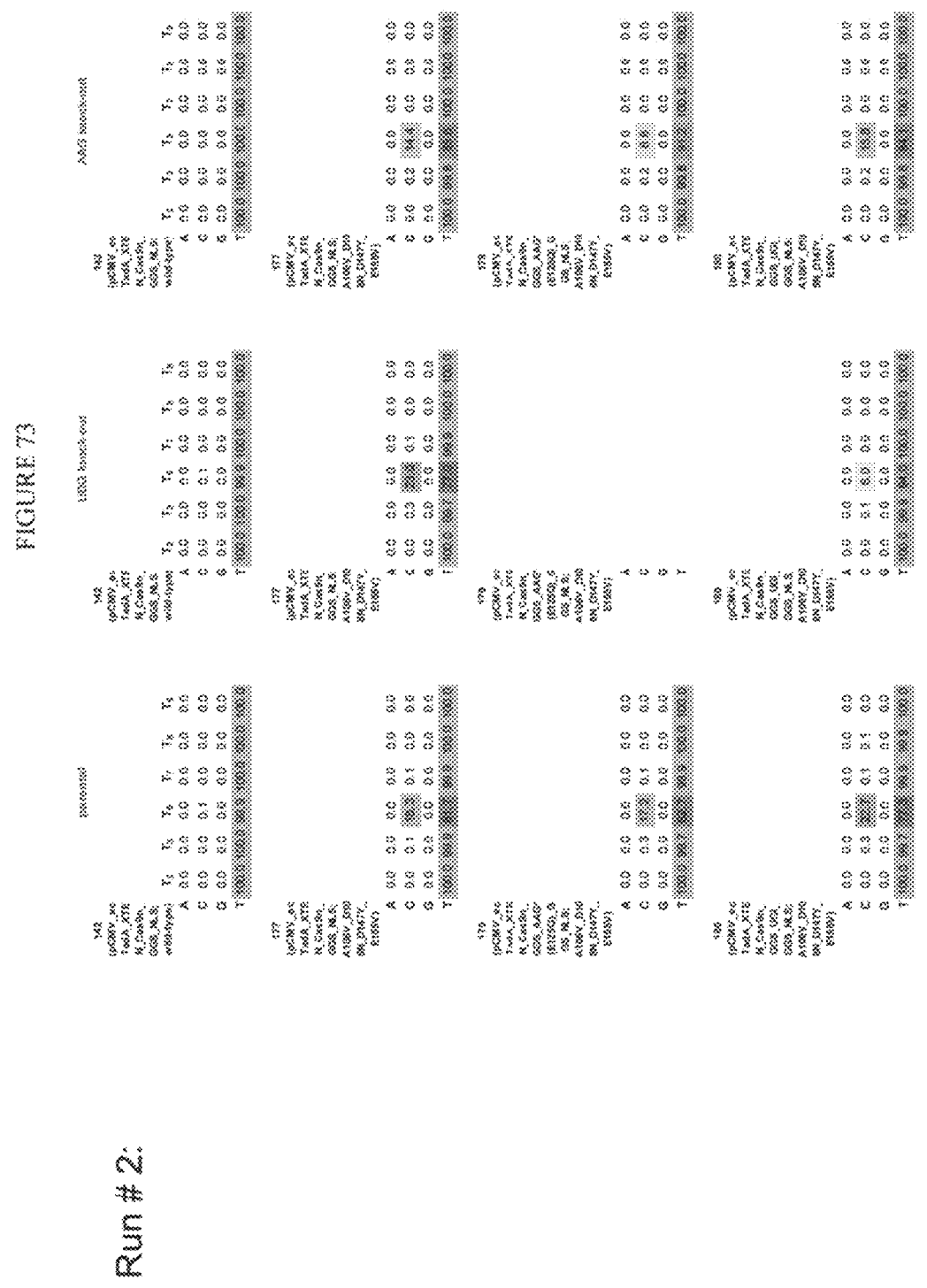

FIG. 73 shows the results of the second run with various edTadA mutations using the sequence of FIG. 71.

FIG. 74 shows a FANCF sequence. The sequence corresponds to SEQ ID NO: 45.

FIG. 75 shows the results of the second run using various edTadA mutations and the sequence of FIG. 74.

Figure 76:
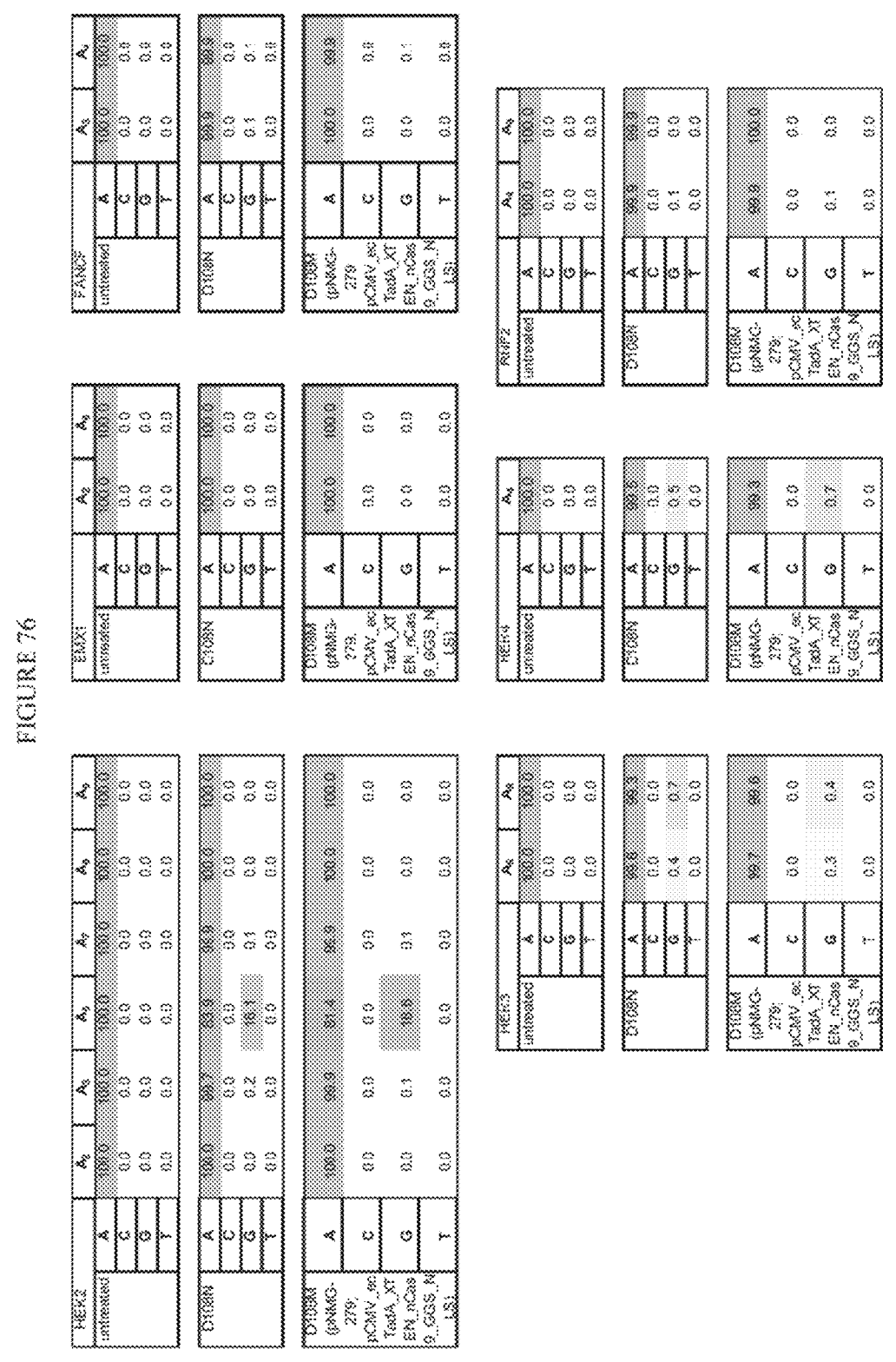

FIG. 76 shows the results of mutated D108 on all sites.

Figure 77:
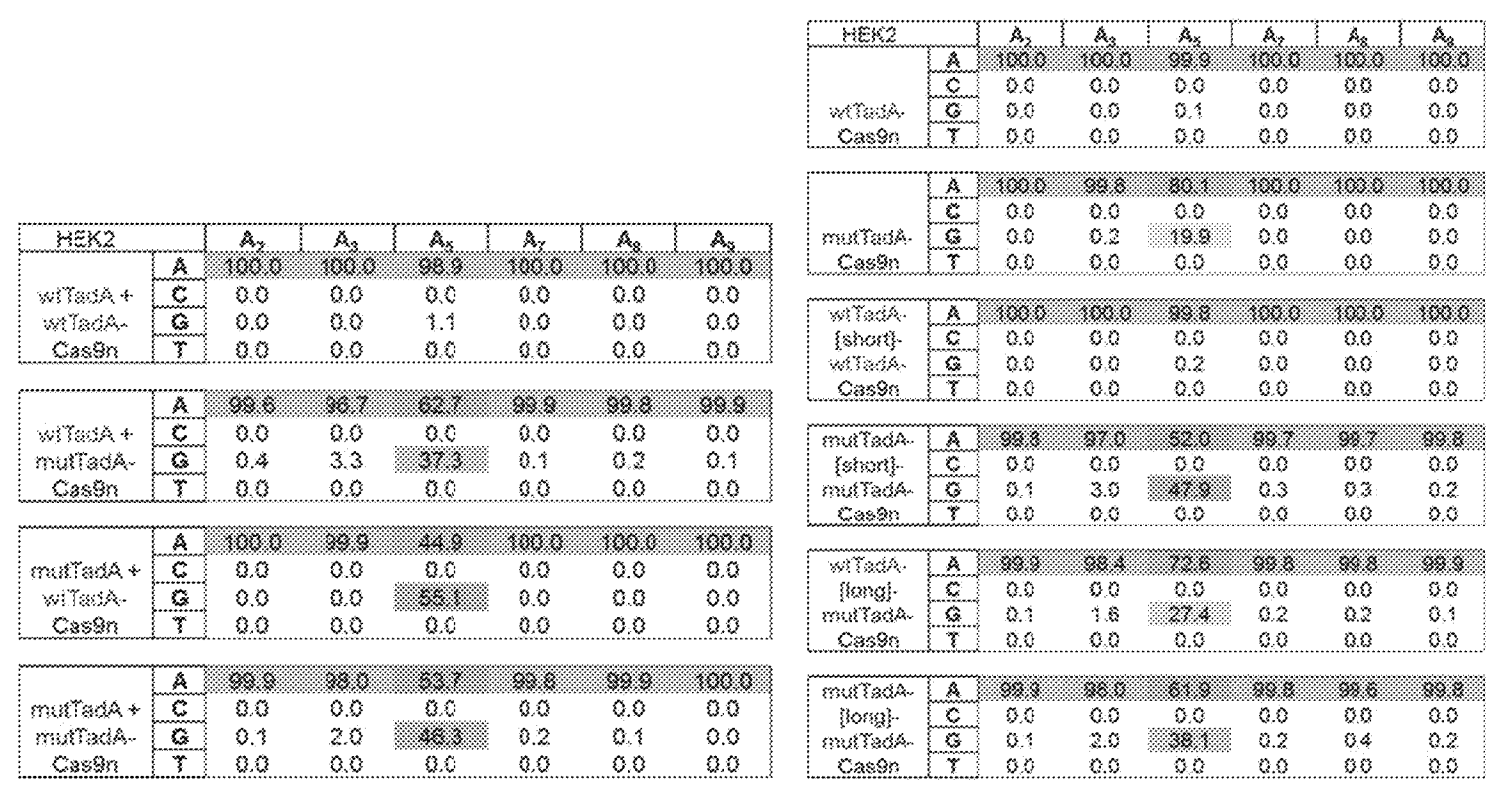

FIG. 77 shows in trans data from previous run (left panel) and the mut-mut fusions hindered by super long linkers.

Figure 78:
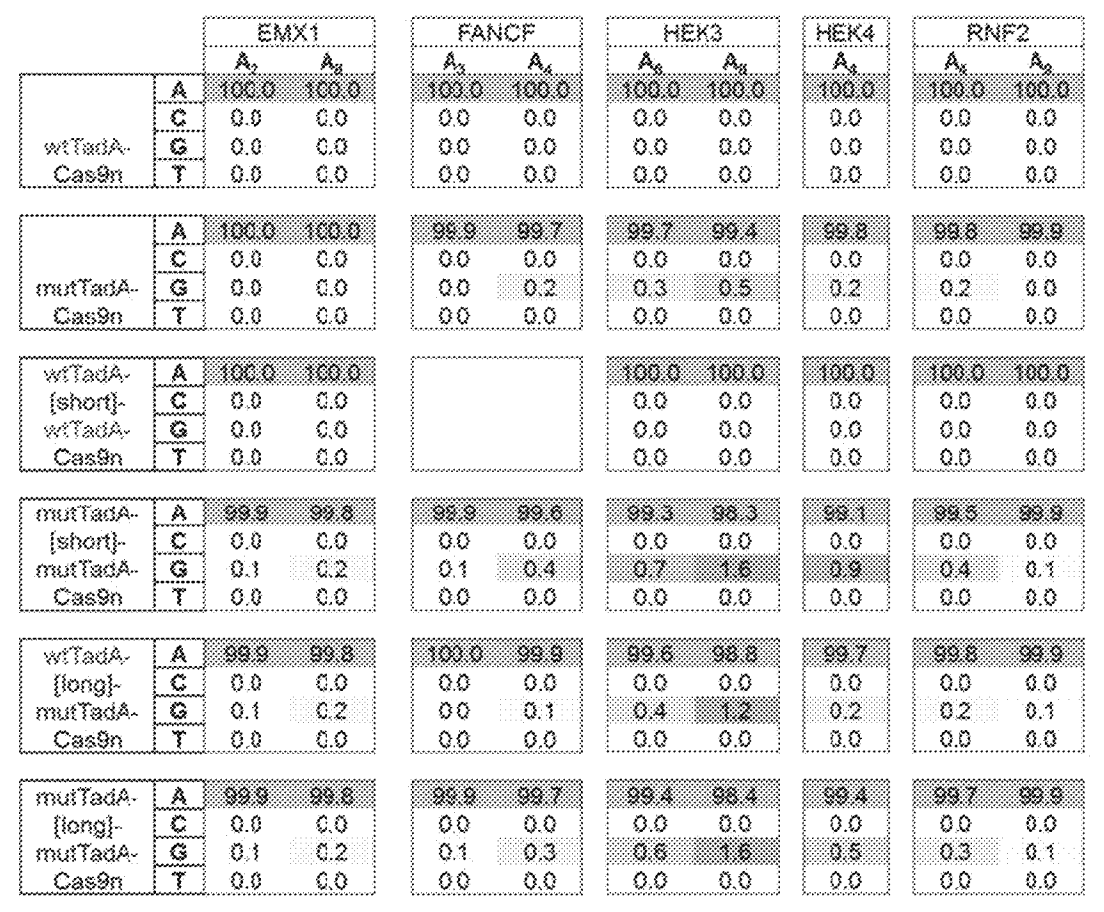

FIG. 78 shows the results of tethering mutTadA to ABE.

FIG. 86 shows the constructs used when tethering EndoV to ABE.

FIG. 87 is a schematic showing the tethering EndoV to ABE.

FIG. 88 shows the results of tethering EndoV to ABE.

FIG. 89 shows the constructs used when tethering UGI to ABE.

FIG. 90 shows the results of tethering UGI to the end of ABE.

FIG. 108 shows a summary of results of editing at the Hek-2 site. The Hek-2 sequence provided in the figure represents the reverse complement of SEQ ID NO: 41, which is the DNA strand where A to G editing takes place. The sequence corresponds to SEQ ID ID: 6.

FIG. 109 shows a summary of results of editing at the Hek2-3 site. The sequence corresponds to SEQ ID NO: 363.

FIG. 110 shows a summary of results of editing at the Hek2-6 site. The sequence corresponds to SEQ ID NO: 364.

FIG. 111 shows a summary of results of editing at the Hek2-7 site. The Hek2-7 sequence provided in the figure represents the reverse complement of the DNA strand where A to G editing takes place. The sequence corresponds to SEQ ID NO: 365.

FIG. 112 shows a summary of results of editing at the Hek2-10 site. The sequence corresponds to SEQ ID NO: 366.

Figure 113:
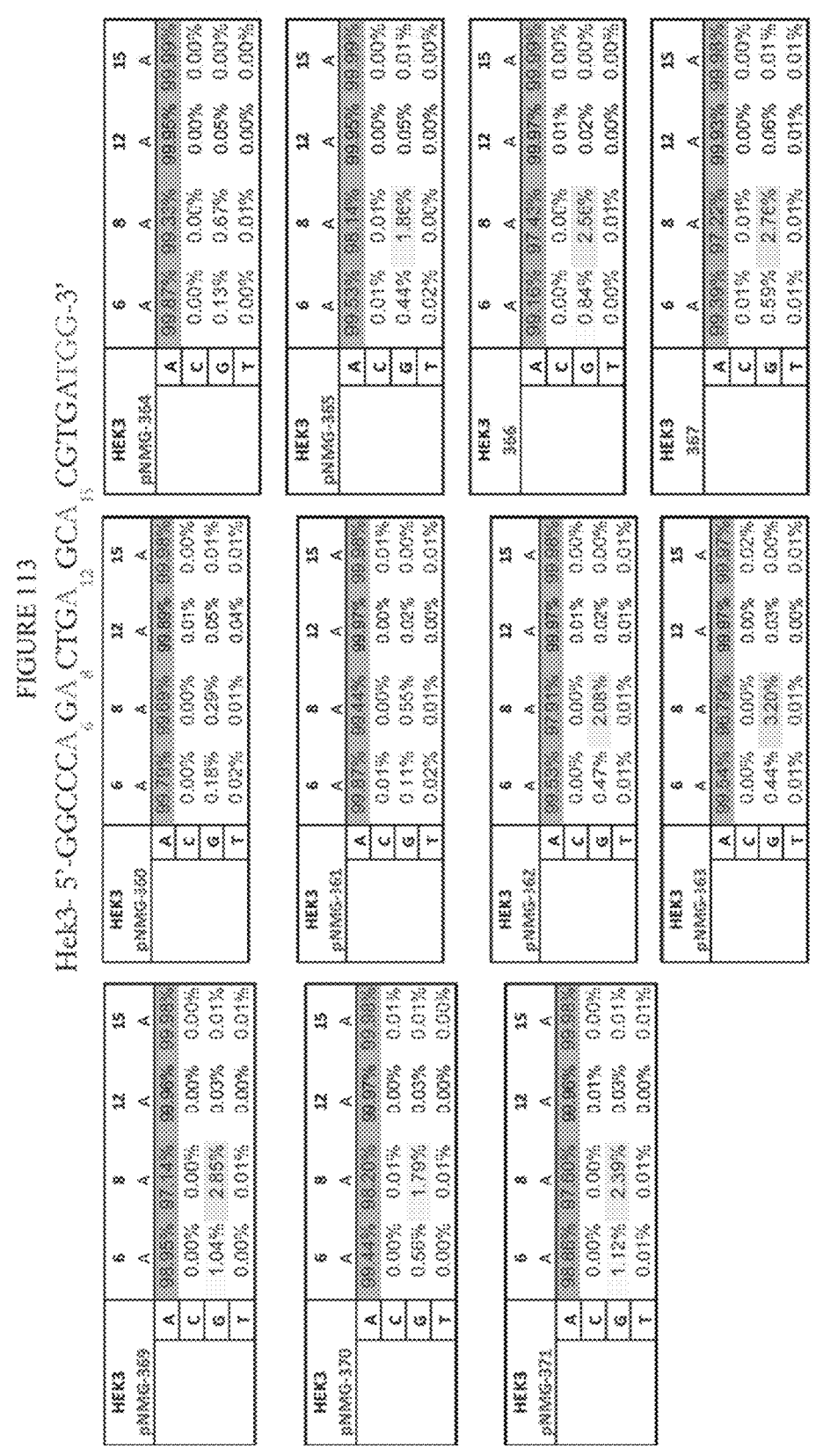

FIG. 113 shows a summary of results of editing at the Hek-3 site. The sequence corresponds to SEQ ID NO: 42.

Figure 114:
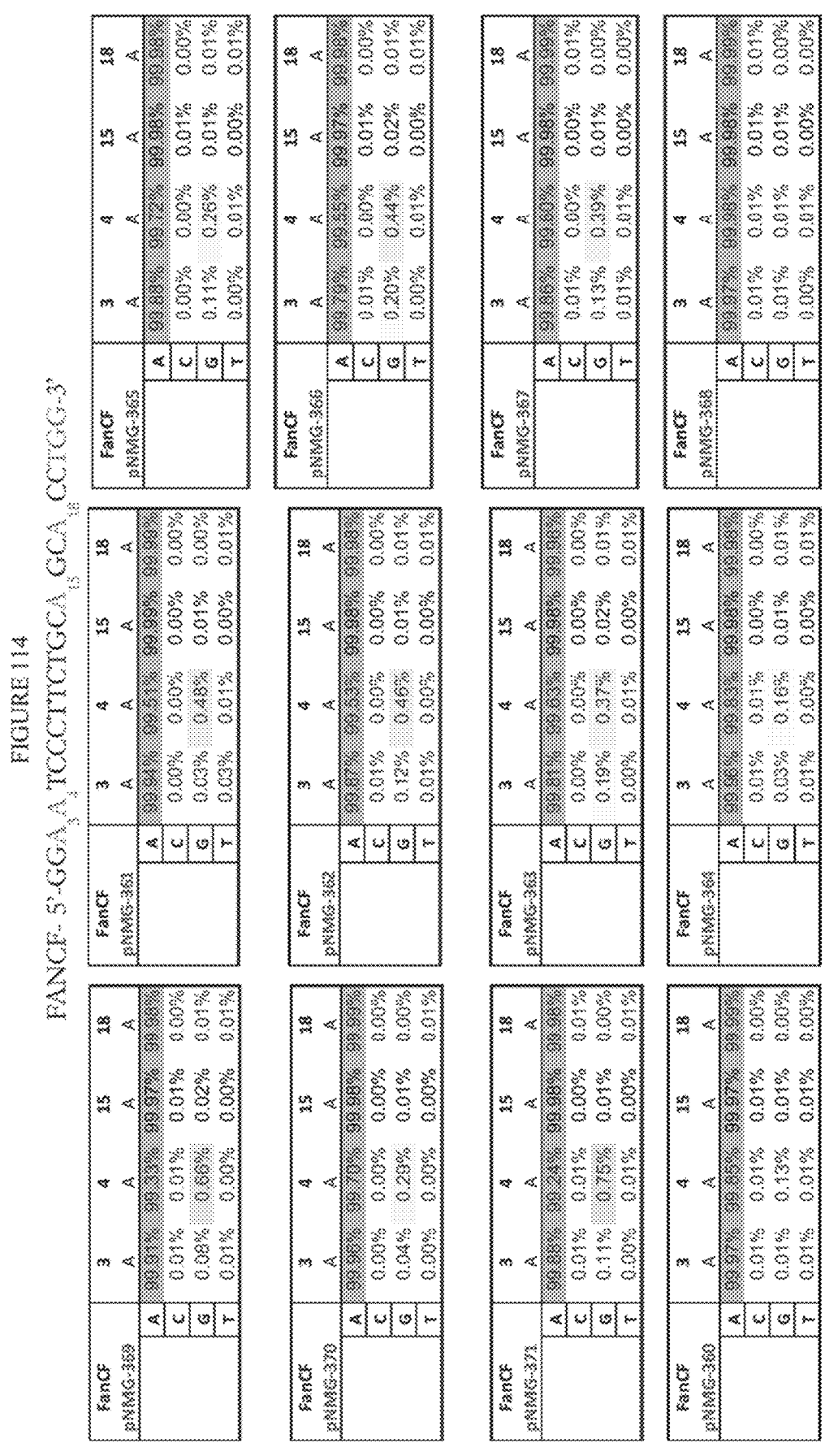

FIG. 114 shows a summary of results of editing at the FANCF site. The sequence corresponds to SEQ ID NO: 45.

FIG. 115 shows a summary of results of editing at the Hek-2 site. The sequence corresponds to SEQ ID NO: 367.

FIG. 116 shows a summary of results of editing at the Hek2-2 site. The sequence corresponds to SEQ ID NO: 368.

FIG. 117 shows a summary of results of editing at the Hek2-3 site. The sequence corresponds to SEQ ID NO: 363.

FIG. 118 shows a summary of results of editing at the Hek2-6 site. The sequence corresponds to SEQ ID NO: 364.

FIG. 119 shows a summary of results of editing at the Hek2-7 site. The sequence corresponds to SEQ ID NO: 365.

FIG. 120 shows a summary of results of editing at the Hek2-10 site. The sequence corresponds to SEQ ID NO: 366.

FIG. 121 shows a summary of results of editing at the Hek-3 site. The sequence corresponds to SEQ ID NO: 42.

FIG. 122 shows a summary of results of editing at the FANCF site. The sequence corresponds to SEQ ID NO: 45.

Figures 123, 124:
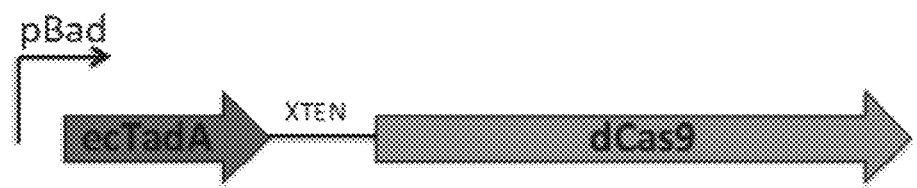

FIG. 123 shows the results of ecTadA evolution (evolution #4) at HEK2, HEK2-2, HEK2-3, HEK2-6, HEK2-7, and HEK2-10 sites. The constructs used were pNMG-370 (evolution #2), pNMG-371 (evolution #3), and pNMG 382-389 (evolution #4). The sequences correspond to SEQ ID NOs: 7, 368, 363, 364, 369, and 370 from top to bottom, respectively.

FIG. 124 shows a schematic of a construct containing ecTadA and dCas9 used for ecTadA evolution (evolution #5).

FIG. 125 is a table showing the results of clones assayed after fifth round evolution (128 ug/mL chlor, 7 h).

FIGS. 126A to 126E are tables showing the results of sub-cloned and re-transformed clones assayed after fifth round under varying conditions.

FIG. 127 is a table showing the results of amplicons from spectinomycin selection clones assayed after fifth round evolution.

Figure 128:
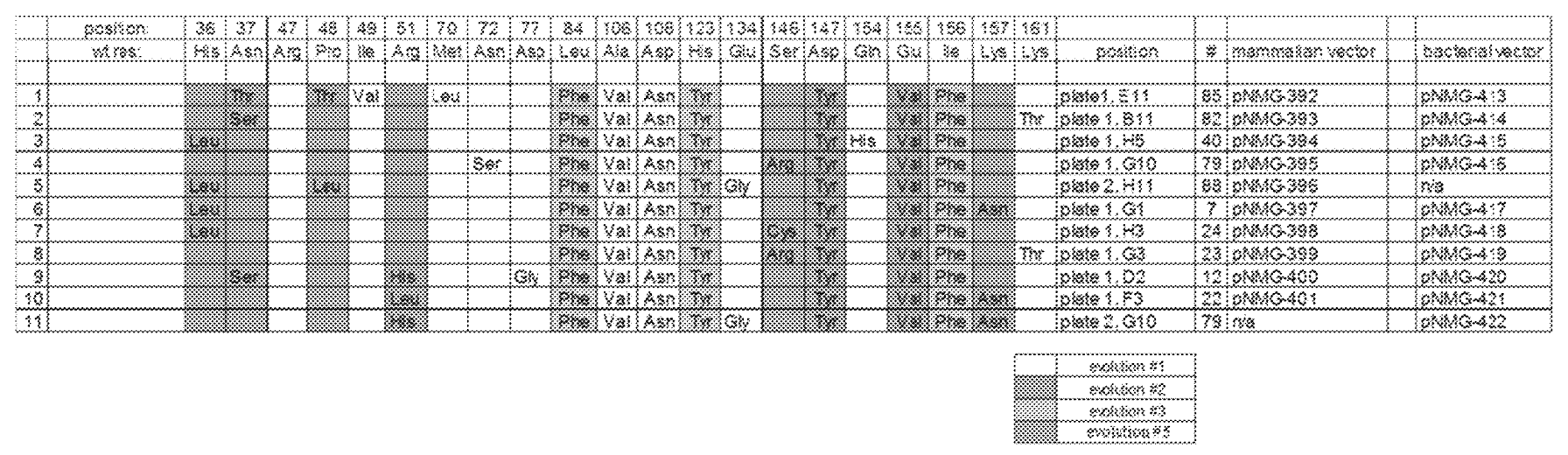

FIG. 128 is a table showing the results of clones assayed after fifth round evolution.

FIG. 129 shows a summary of results of editing at the Hek-2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 6.

FIG. 130 shows a summary of results of editing at the Hek2-1site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-1 sequence provided in the figure represents the DNA strand where A to G editing takes place. The sequence corresponds to SEQ ID NO: 465.

FIG. 131 shows a summary of results of editing at the Hek2-2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 368.

FIG. 132 shows a summary of results of editing at the Hek2-3 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 363.

FIG. 133 shows a summary of results of editing at the Hek2-4 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-4 sequence provided in the figure represents the DNA strand where A to G editing takes place. The sequence corresponds to SEQ ID NO: 466.

FIG. 134 shows a summary of results of editing at the Hek2-6 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 364.

FIG. 135 shows a summary of results of editing at the Hek2-9 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-9 sequence provided in the figure represents the DNA strand where A to G editing takes place. The sequence corresponds to SEQ ID NO: 467.

FIG. 136 shows a summary of results of editing at the Hek2-10 site using base editors that contain an engineered *S. aureus* TadA (saTadA), which include pNMG-346-349. As a comparison, results of editors that contain an engineered *E. coli* TadA (ecTadA), which include pNMG-339-341, are shown. The Hek2-10 sequence provided in the figure represents the DNA strand where A to G editing takes place. The sequence corresponds to SEQ ID NO: 370.

FIG. 137 shows a summary of results of editing at the Hek3 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 42.

FIG. 138 shows a summary of results of editing at the RNF2 site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 468.

FIG. 139 shows a summary of results of editing at the FANCF site using base editors that contain an engineered *S. aureus* TadA (saTadA), which include pNMG-346-349. As a comparison, results of editors that contain an engineered *E. coli* TadA (ecTadA), which include pNMG-339-341, are shown. The sequence corresponds to SEQ ID NO: 45.

Figure 140:
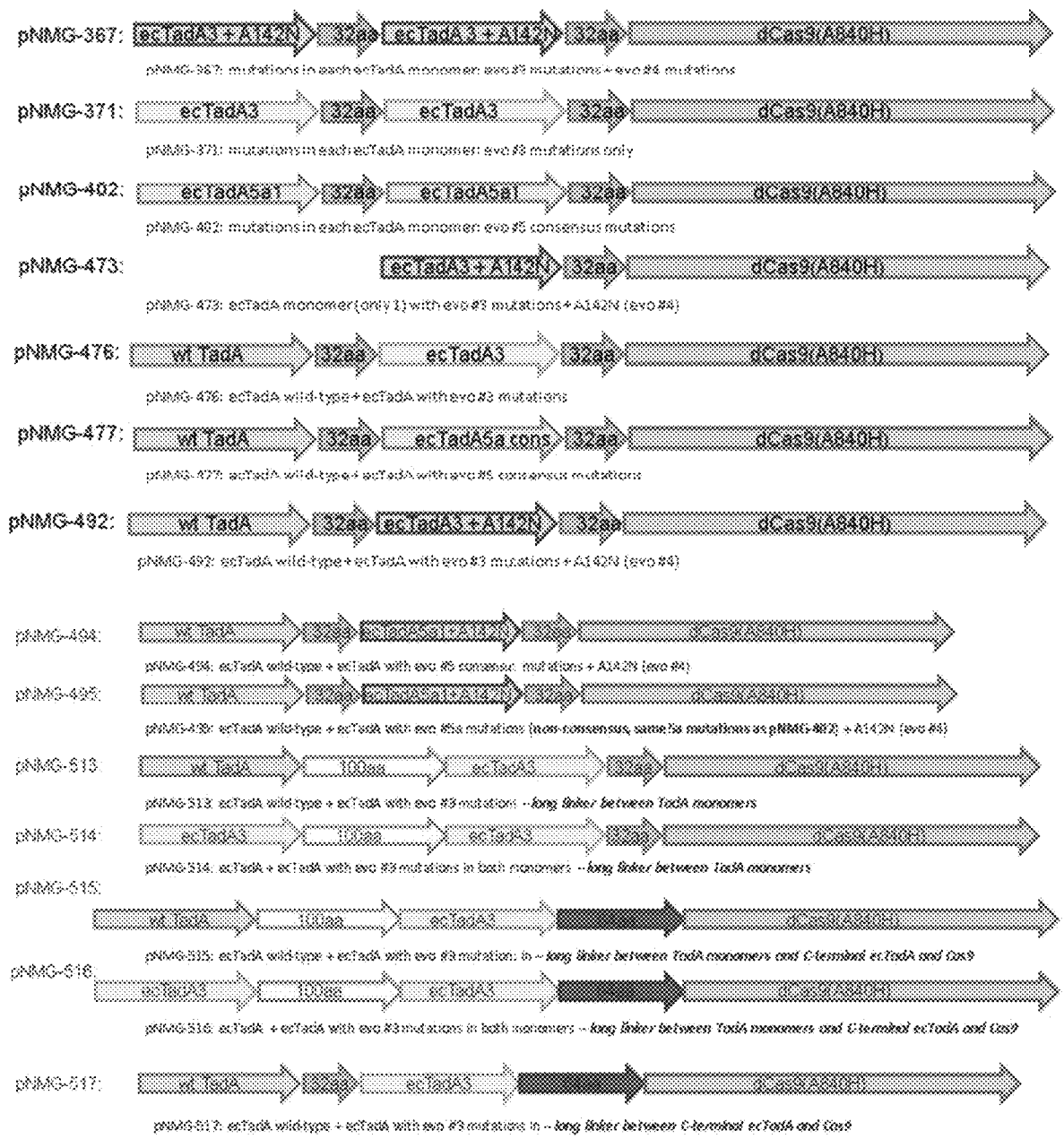
Figure 140:
Figure 140:
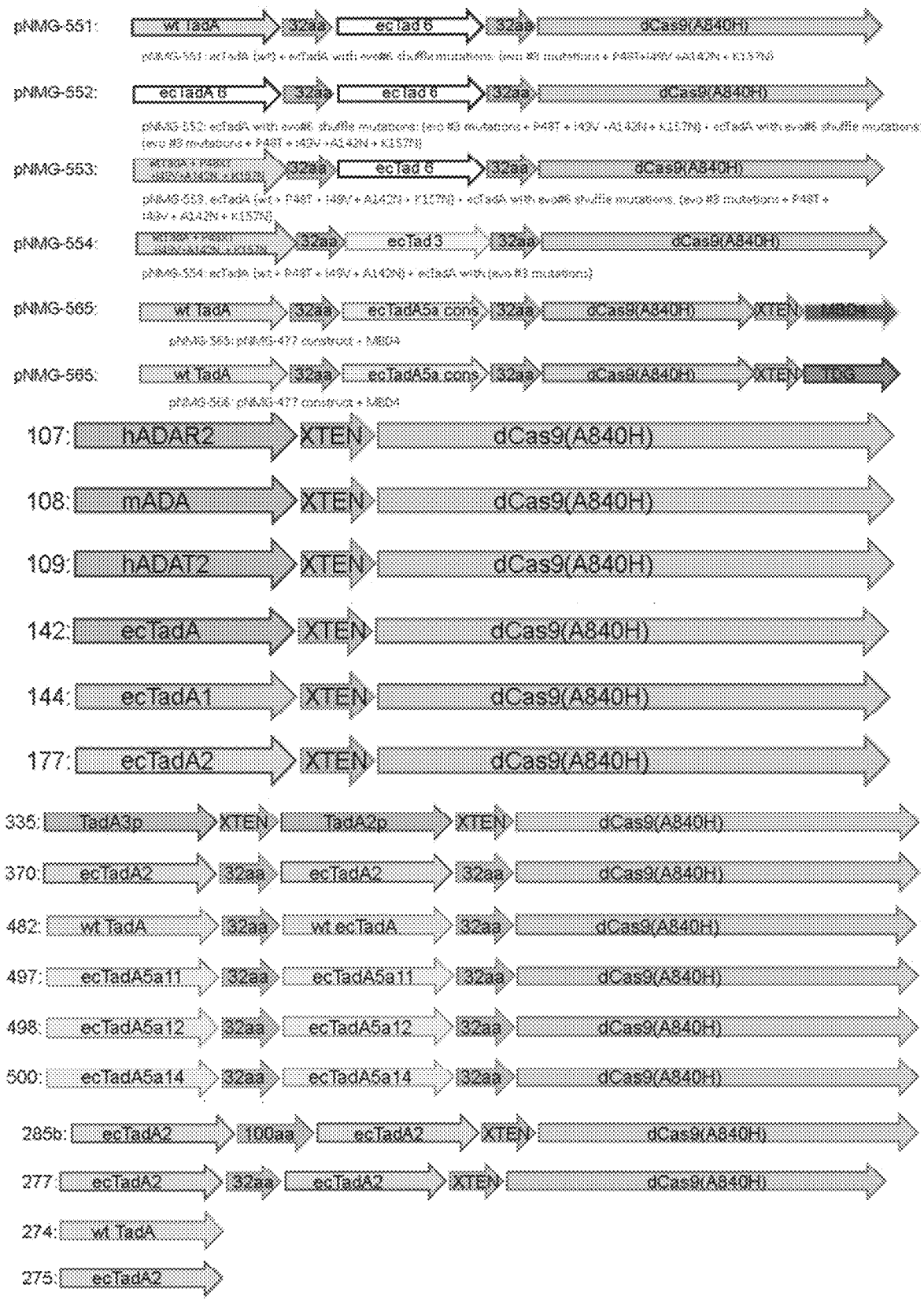

FIG. 140 shows various schematic representations of adenosine base editor (ABE) constructs. The identity of the editors e.g., "pNMG-367" is indicated in Table 4. The following mutations are abbreviated as follows: ecTadA1 (A106V D108N), ecTadA2 (A106V D108N D147Y E155V), ecTadA3 (ecTadA2+L84F H123Y I156F), ecTadA3+(ecTadA3+A142N), ecTadA5a1 (ecTadA3+R51L S146C K157N), ecTadA5a3 (ecTadA3+N37S K161T), ecTadA5a11 (ecTadA3+R51L S146C K157N K161T), ecTadA5a12 (ecTadA3+S146C K161T), ecTadA5a14 (ecTadA3+RS146C K157N K160E), and ecTadA5a1+(ecTadA5a1+A142N), ecTadA5a9 (ecTadA3+S146R K161T). Heterodimers of the top three ABE 5a constructs were made and then tested relative to homodimers. The heterodimer version of the ABE editor typically performs better than the corresponding homodimeric construct. Both homodimeric and heterodimeric constructs are shown in FIG. 140.

Figure 141:
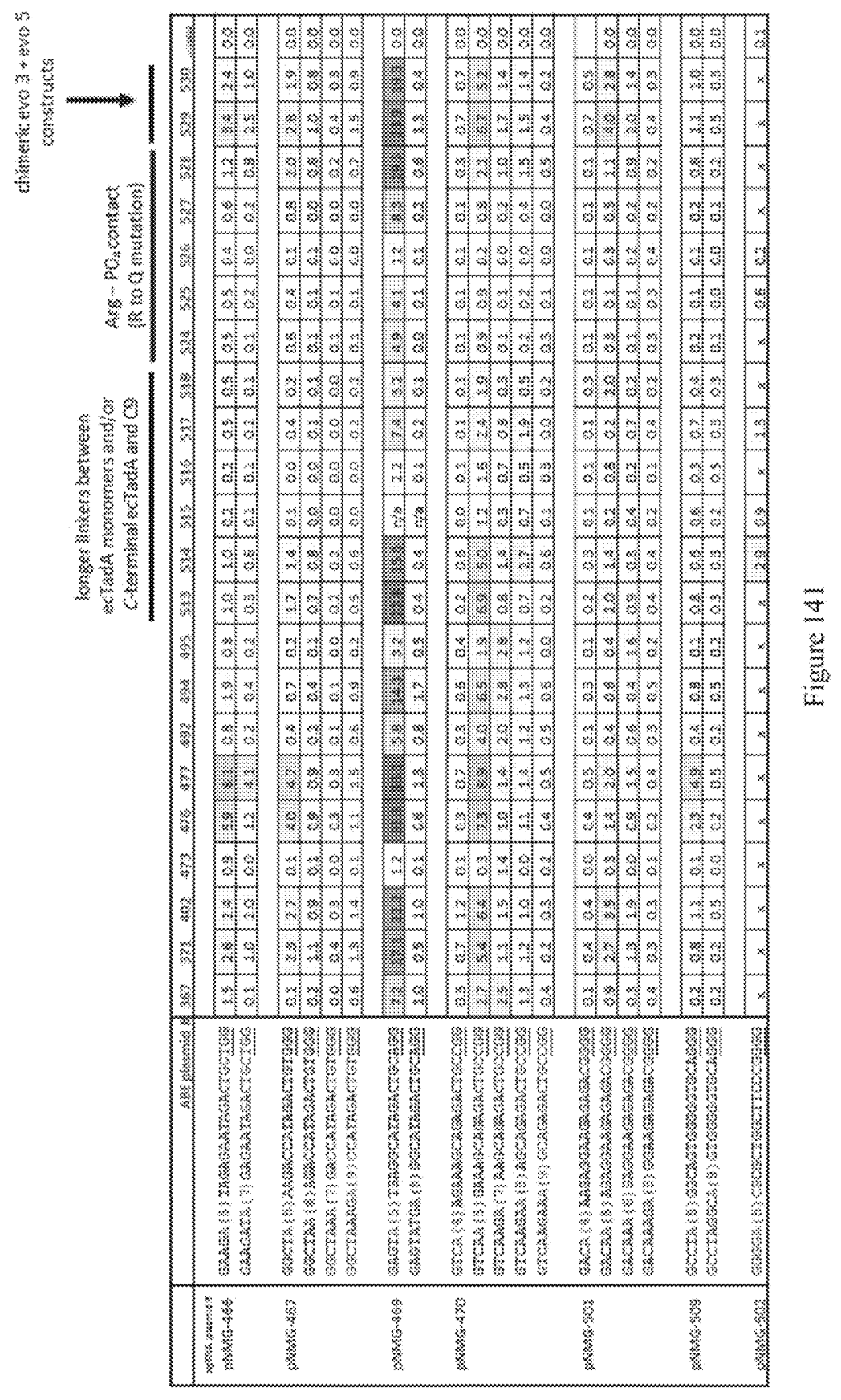

FIG. 141 shows editing results for various ABE constructs. The ABE plasmid # refers to pNMG number as indicated in Table 4. For example, 367 refers to construct pNMG-367 in Table 4. The sequences correspond to SEQ ID NOs: 469 (pNMG-466), 470 (pNMG-467), 471 (pNMG-469), 472 (pNMG-470), 473 (pNMG-501), 474 (pNMG-509), and 475 (pNMG-502) from top to bottom, respectively.

FIG. 142 shows editing results for various ABE constructs at specific sites. The numbers on the top row indicate the pNMG number as indicated in Table 4. For example, 107 refers to construct pNMG-107 in Table 4. In certain contexts, homodimer constructs have been shown to work better than a hetero dimer construct and vice versa (see for example construct 371 which is a homodimer versus construct 476 which is a heterodimer). Schematics for these ABE constructs are shown in FIG. 140, and the construct architecture is shown in Table 4. The sequences correspond to SEQ ID NOs: 478, 478, 514, 516, 516, 520, 520, 521, 521, and 509 from top to bottom, respectively.

FIG. 143 shows the percentage of indels formed for ABE constructs from FIG. 142.

FIG. 144 shows editing results for various ABE constructs at specific sites. The identity of the constructs are shown in the top row and refer to the pNMG reference number of Table 4. The results in FIG. 144 indicate that adding ecTadA monomer to ABE construct may not improve editing. However, adding a long linker between monomers may help editing at some sites (see, for example, the editing results for sgRNA constructs 285b versus 277 at sites 502, 505, 507). The identity of the sgRNA constructs is shown in Table 8 Schematics for these ABE constructs are shown in FIG. 140. The sequences correspond to SEQ ID NOs: 478, 480, 480, 514, 517, 517, 517, 517, 519, and 521 from top to bottom, respectively.

FIG. 145 shows results for ABE constructs at all NAN sites, where the target A is at position 5 of the Protospacer and PAM sequences. The identity of the ABE constructs, shown in the top row refers to the pNMG reference number in Table 4. The number values represent the % of target A residues that were edited (e.g., % editing efficiency). The sequences correspond to SEQ ID NOs: 537-552 from top to bottom, respectively.

Figure 146:
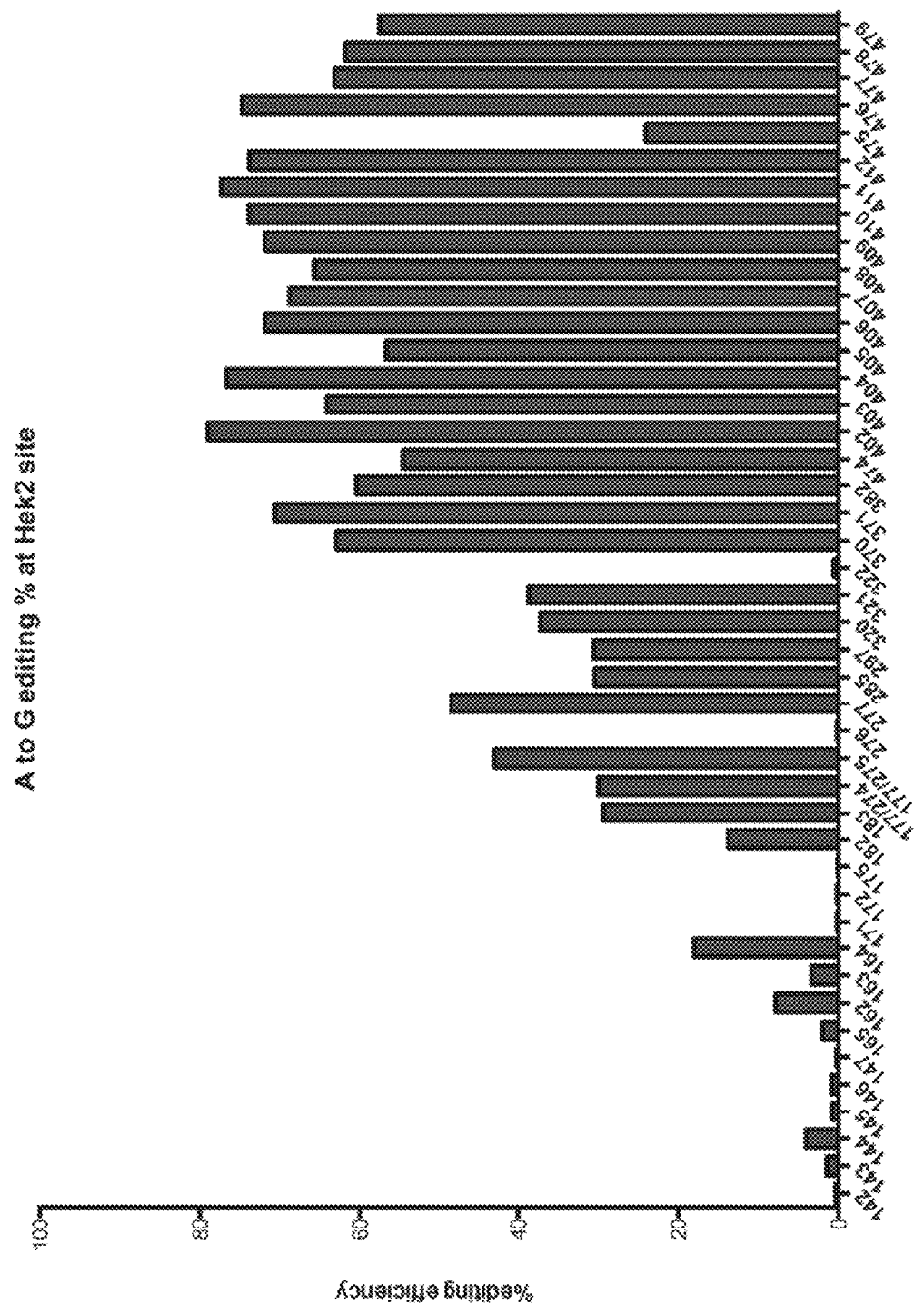

FIG. 146 shows A to G editing percent at the Hek2 site for various ABE constructs as referenced by their reference pNMG number in Table 4.

Figure 147:
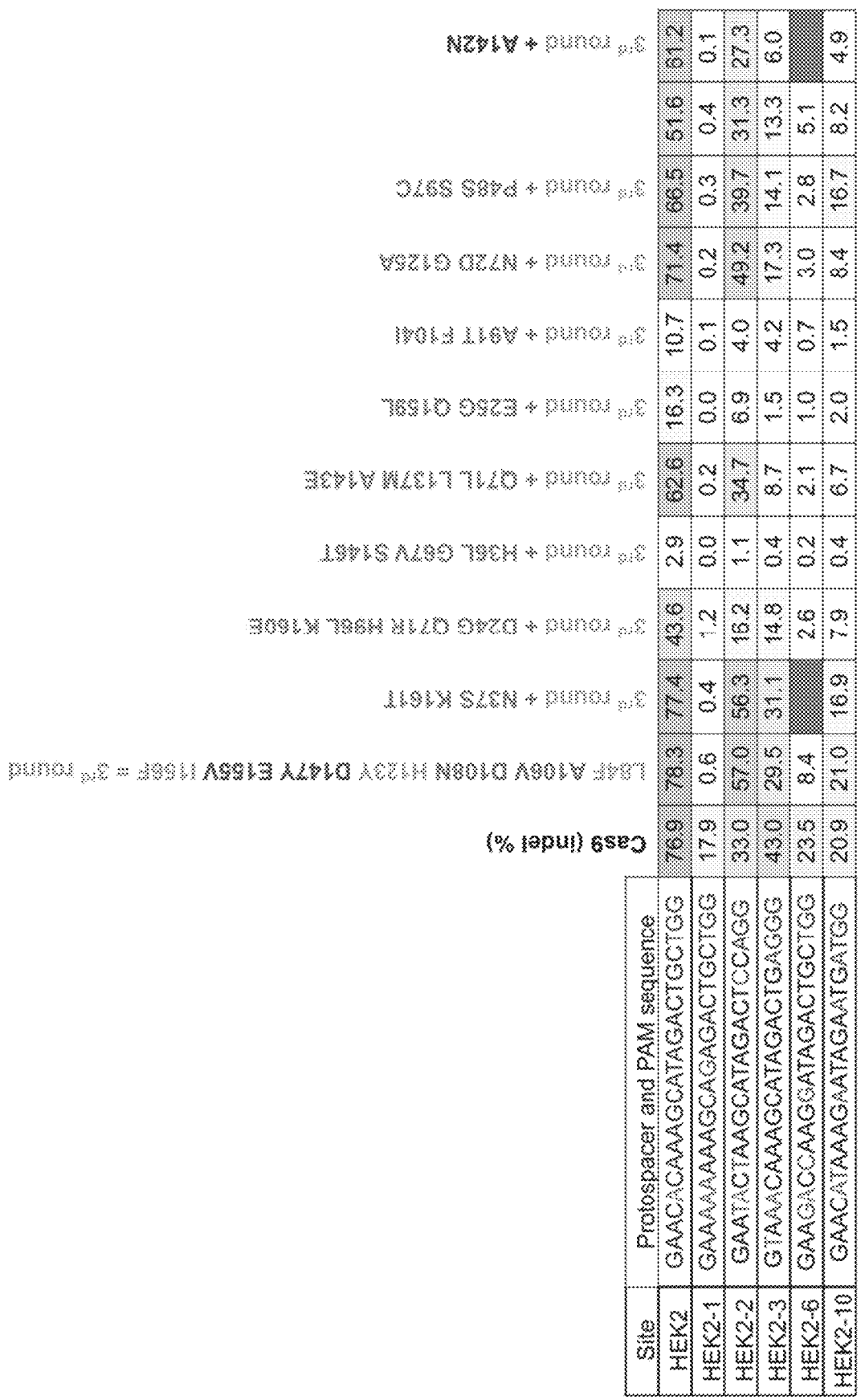

FIG. 147 shows evolution round #5b evolution results. The number values represent the % of A to G editing for the indicated sites. The sequences from top to bottom correspond to SEQ ID NOs: 7, 465, 368, 363, 364, and 370 from top to bottom, respectively.

Figure 148:
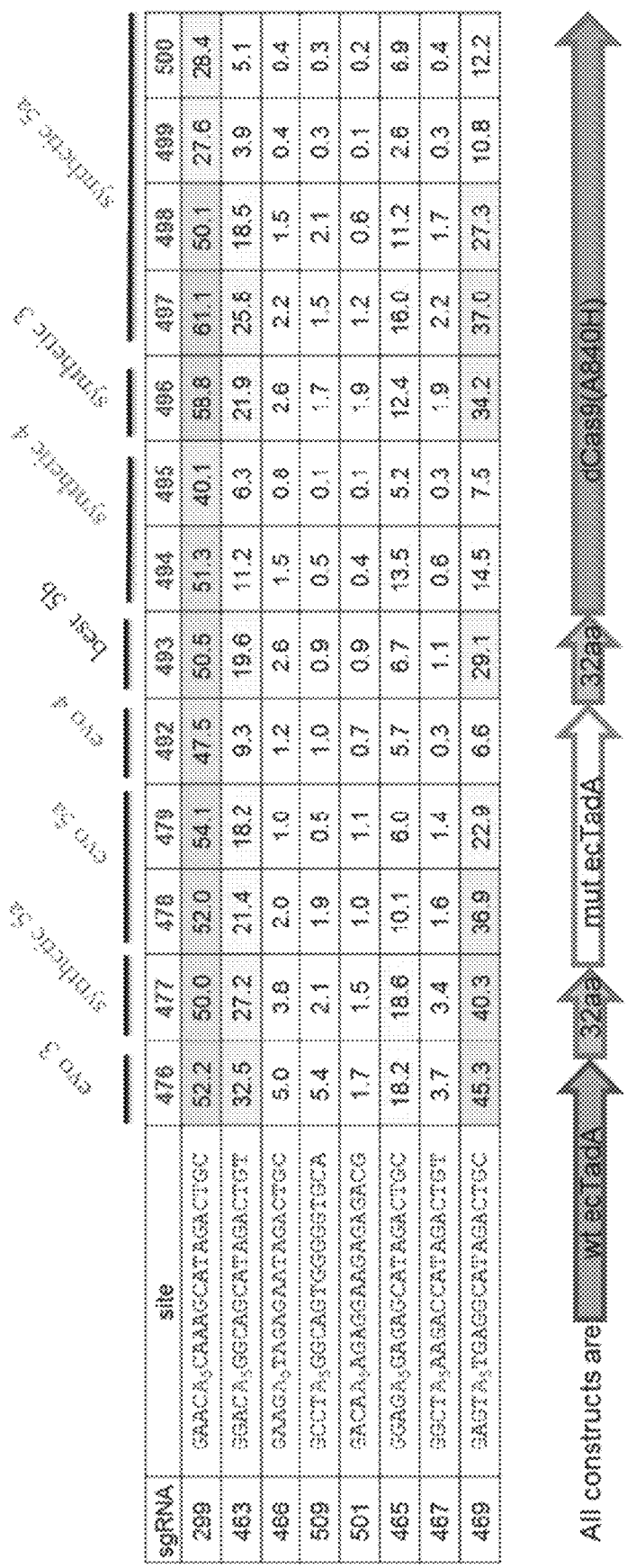

FIG. 148 shows editing results for various ABE constructs which were obtained from different rounds of evolution (e.g., evo3). The generic schematic for the ABE constructs is also shown. The identity of the sgRNA, as indicated in Table 8, and the identity of the base editors (pNMG reference), as indicated in Table 4, are shown. The number values represent the % of A to G editing for the indicated sites. The sequences correspond to SEQ ID NOs: 478, 503, 506, 521, 513, 505, 507, and 509 from top to bottom, respectively.

FIG. 149 shows examination of the ABE constructs at genomic sites other than the Hek-2 sequence. The Hek-2 site (sgRNA 299) is represented by the asterisk. The identity of the sgRNA is indicated in Table 8. The sequences correspond to SEQ ID NOs: 478, 514, 516, 517, 517, 517, 517, 519, 520, 529, 521 from top to bottom, respectively.

Figure 150:
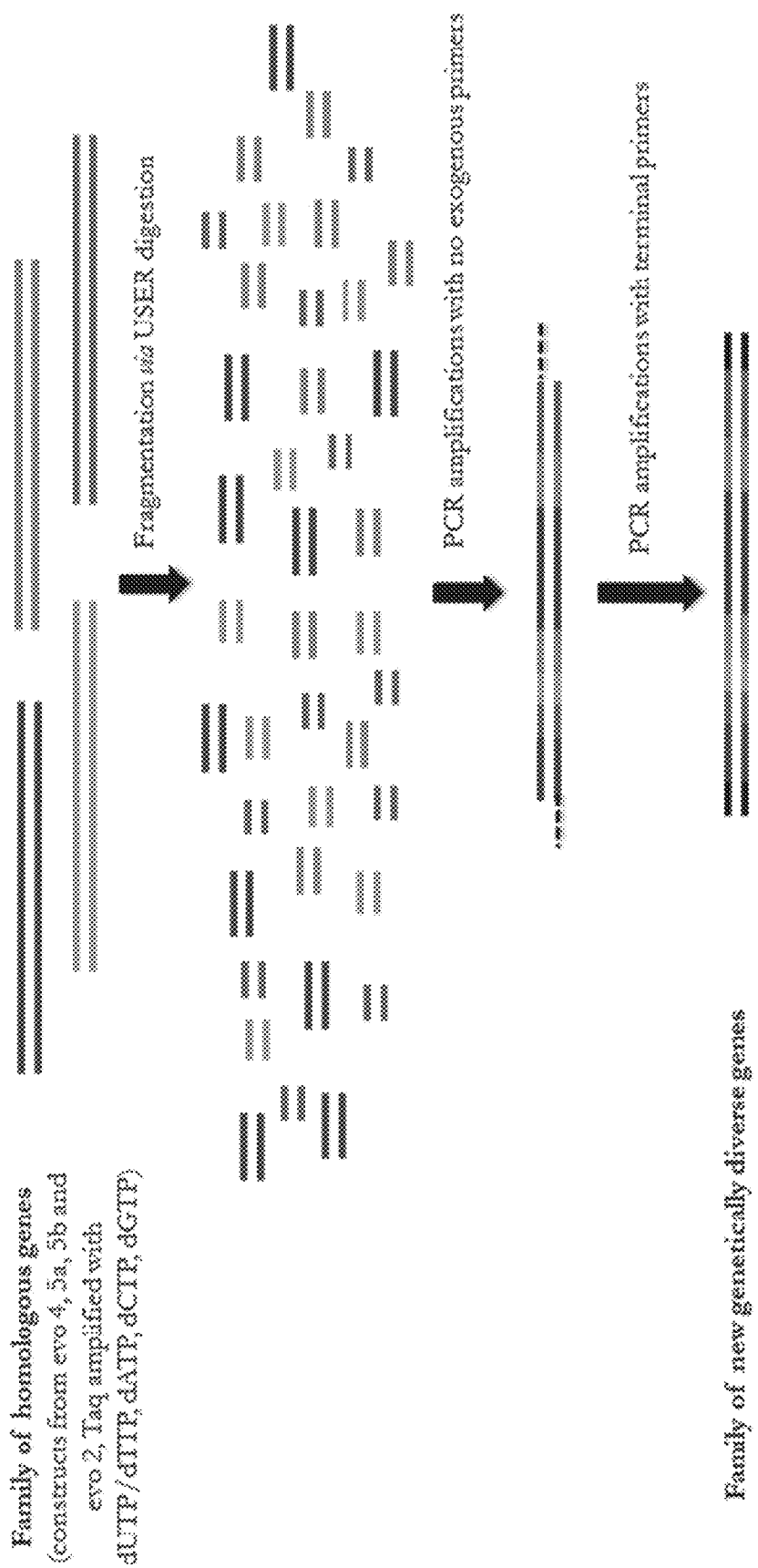

FIG. 150 shows a schematic of the DNA shuffling experiment using nucleotide exchange and excision technology (NExT), which is referred to as ABE evolution #6. The goal of this approach was to assemble a more efficient editor and remove potential epistatic mutations. DNA shuffling of constructs from various evolutions were used to optimize for desired mutations and eliminate mutations that negatively affect editing efficiencies and/or protein stability.

FIG. 151 shows a schematic for DNA Shuffle (NeXT). The spect target sequence is 5'-CAATGATGACTTCTA-CAGCG-3' (SEQ ID NO: 444) and the chlor target sequence is 5'-TACGGCGTAGTGCACCTGGA-3' (SEQ ID NO: 441).

Figure 152:
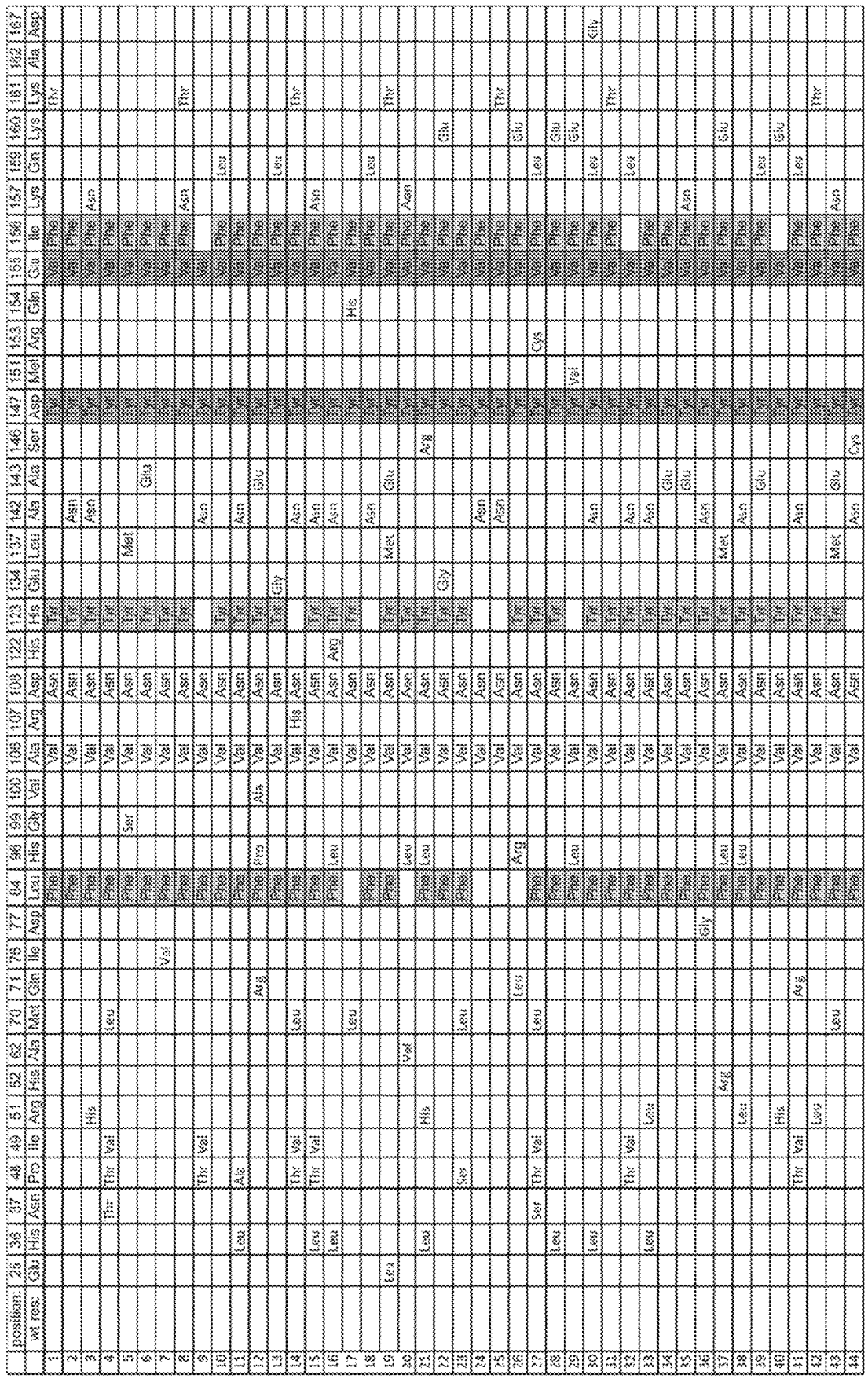

FIG. 152 shows the sequence identity of clones from evolution #6 surviving on aspect only (non-YAC target). The mutations indicated are relative to ecTadA (SEQ ID NO: 1).

Figure 153:
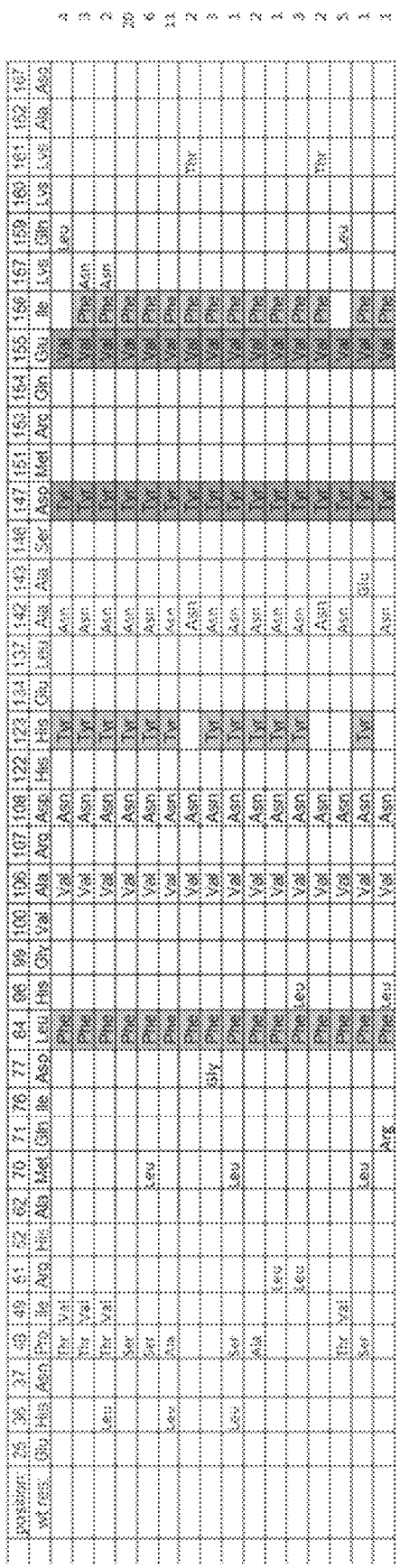

FIG. 153 shows evolution #6.2 which refers to the enrichment of clones from evolution #6. The mutations indicated are relative to ecTadA (SEQ ID NO: 1). A142N is present in almost all clones sequenced and the Pro48 mutation is also abundant. The clones were selected against "GAT" in the spectinomycin site. The selection target sequence was 5'-CAATGATGACTTCTACAGCG-3' (SEQ ID NO: 444).

Figure 154:
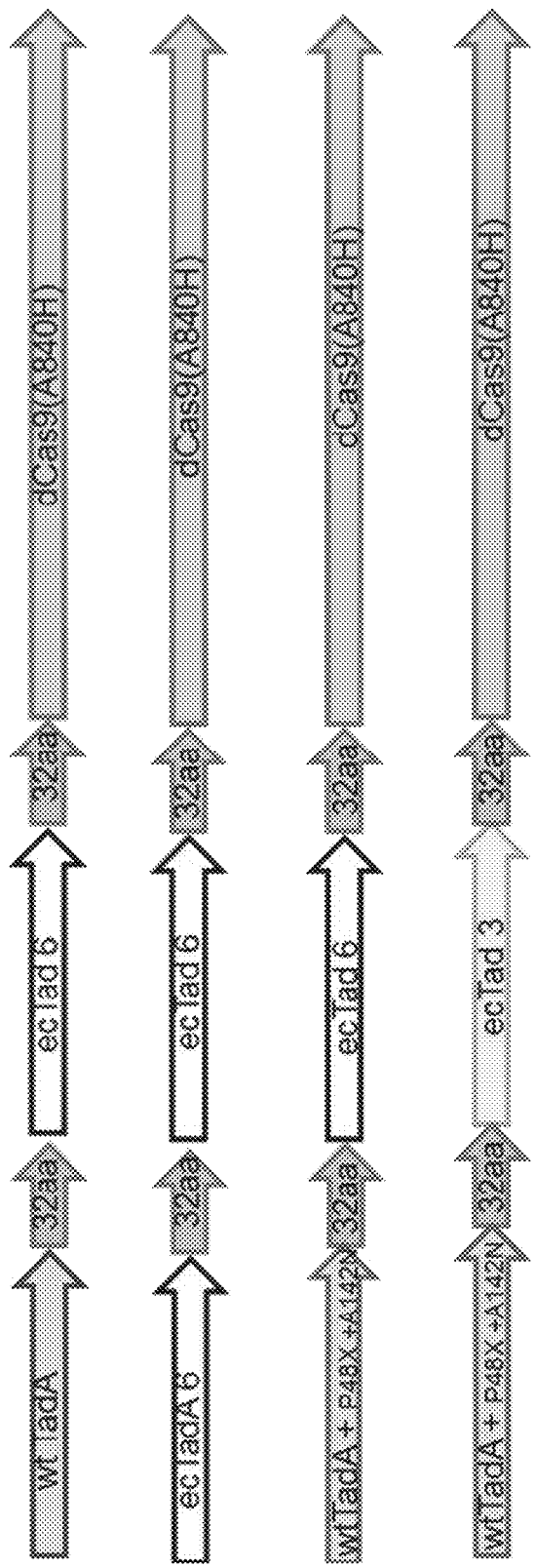

FIG. 154 shows schematic representations of ABE 6 constructs. 8 new constructs in total were developed. Mutations from the top 2 highest frequency amplicons in Evo #6 were used in each of the four architectures.

FIG. 155 shows data harvesting for ABE: step 1—transfection+HTS of key intermediates at 6 genomic sites, n=3. The transfection was performed with 750 ng ABE+250 ng gRNA and incubated for 5 days before the genomic DNA was extracted to perform HTS. The identity of each of the ABE constructs is indicated by the pNMG reference number as shown in Table 4. The sequences correspond to SEQ ID NOs: 509, 510, 512, 520, 530, 478 from top to bottom, respectively.

Figure 156:
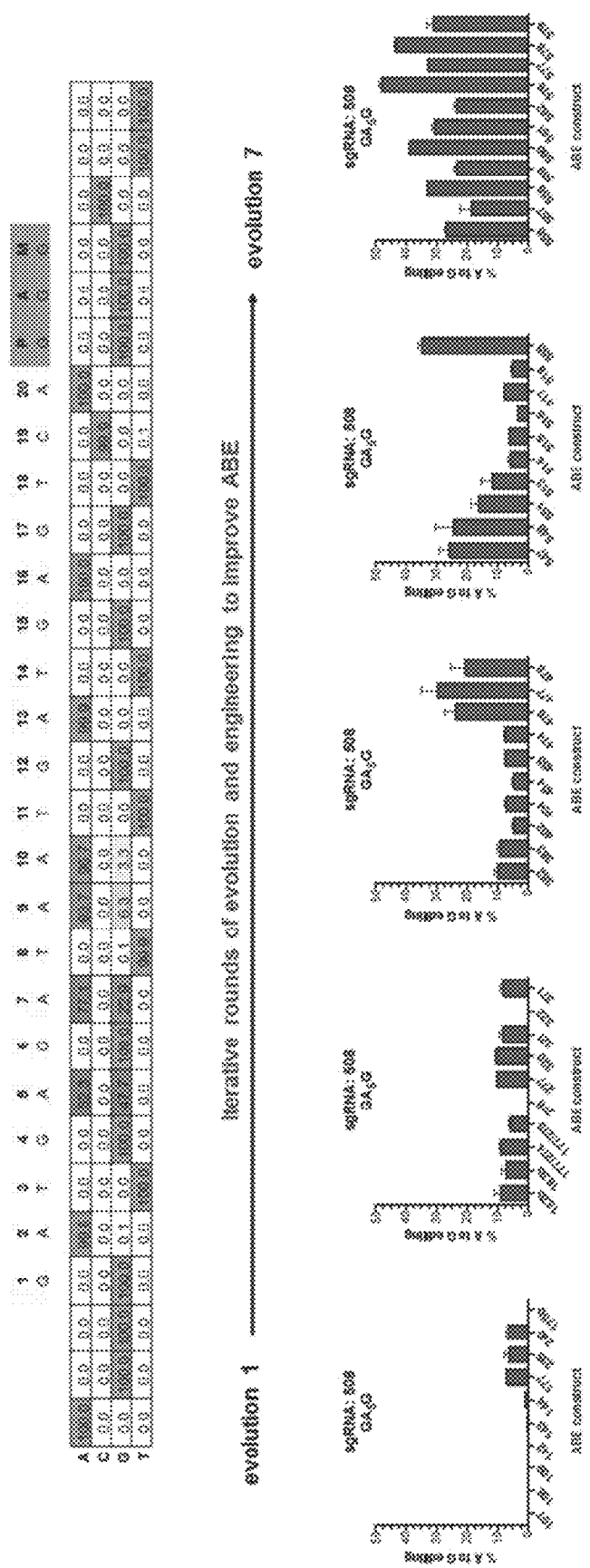

FIG. 156 shows that ABE editing efficiencies improve with iterative rounds of evolution. The top panel shows representative A to G % editing at targeted genetic locus in Hek293T cells using evolved/engineered ABE construct. The sequence corresponds to SEQ ID NO: 561. The bottom panel shows that iterative rounds of evolution and engineering improve ABE. ABE constructs are indicated by their pNMG reference numbers as shown in Table 4. The '508' target sequence corresponds to SEQ ID NO: 520.

Figure 157:
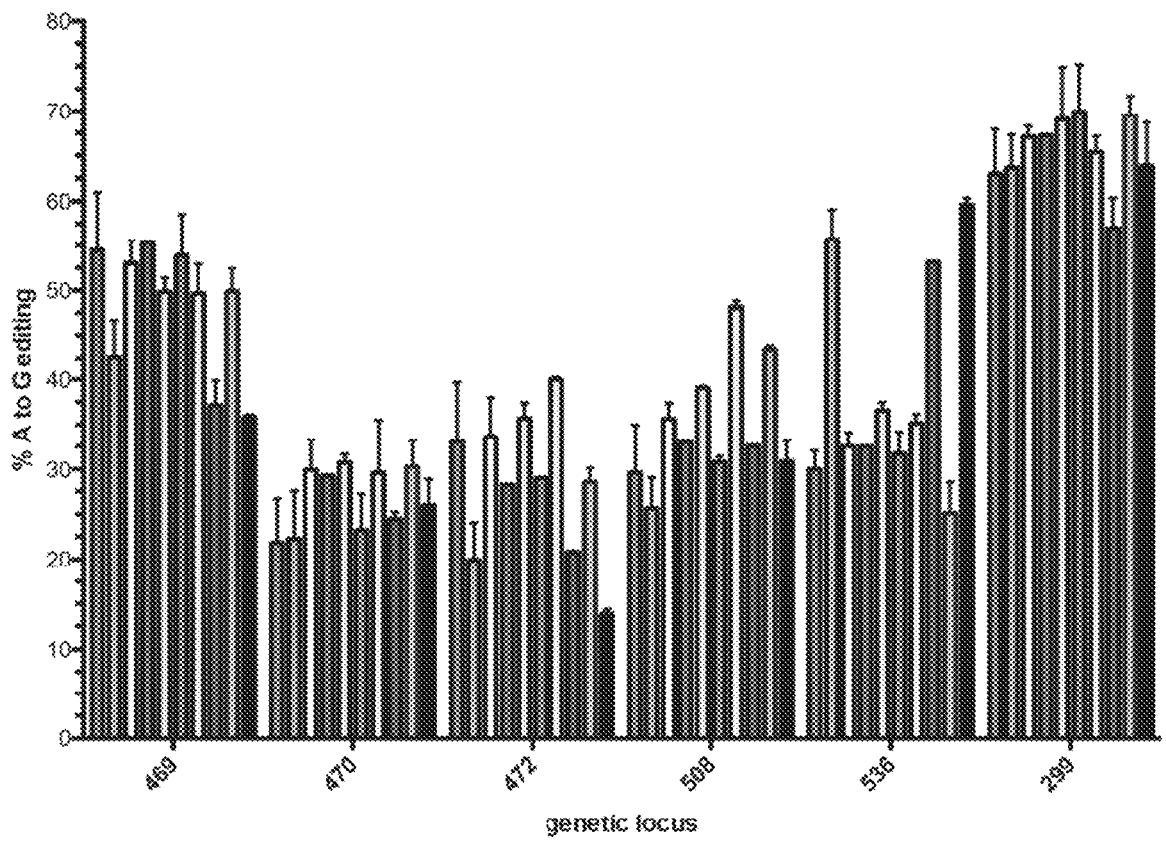

FIG. 157 shows HTS results of core 6 genomic sites from the 10 "Best" ABE. The results indicate that different editors have different local sequence preference (bottom panel). The graph shows the A to G percent editing at 6 different genetic loci. ABE constructs are indicated by their pNMG reference numbers as shown in Table 4. The sequences correspond to SEQ ID NOs: 509, 510, 512, 520, 530, 478 from top to bottom, respectively.

Figure 158:
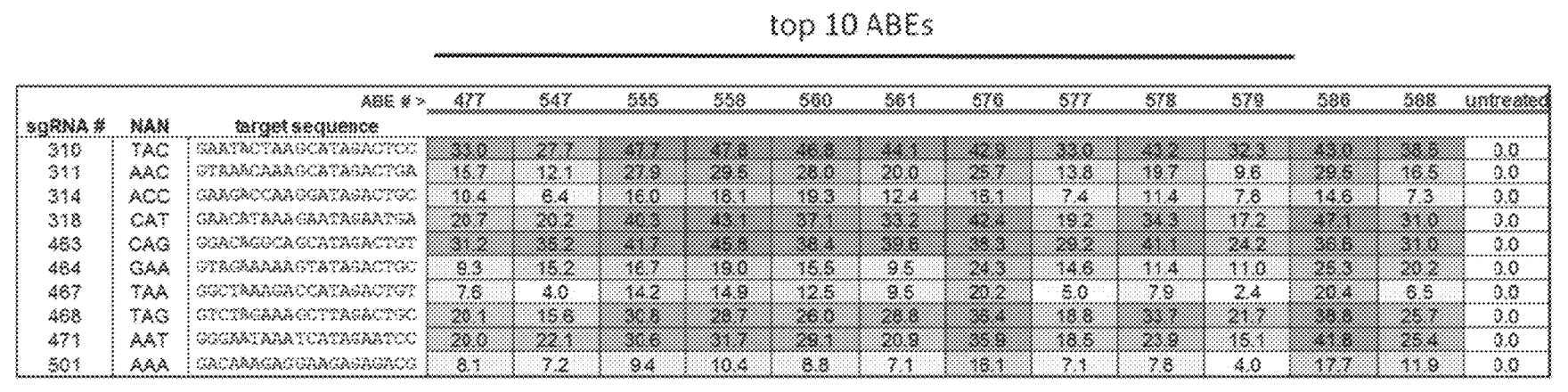

FIG. 158 shows transfection of functioning "top 10" ABEs at all genomic sites covering every combination of NAN sequence. The data represents n=1. The sequences correspond to SEQ ID NOs: 489, 490, 493, 497, 503, 504, 507, 508, 511, and 513 from top to bottom, respectively.

Figure 159:
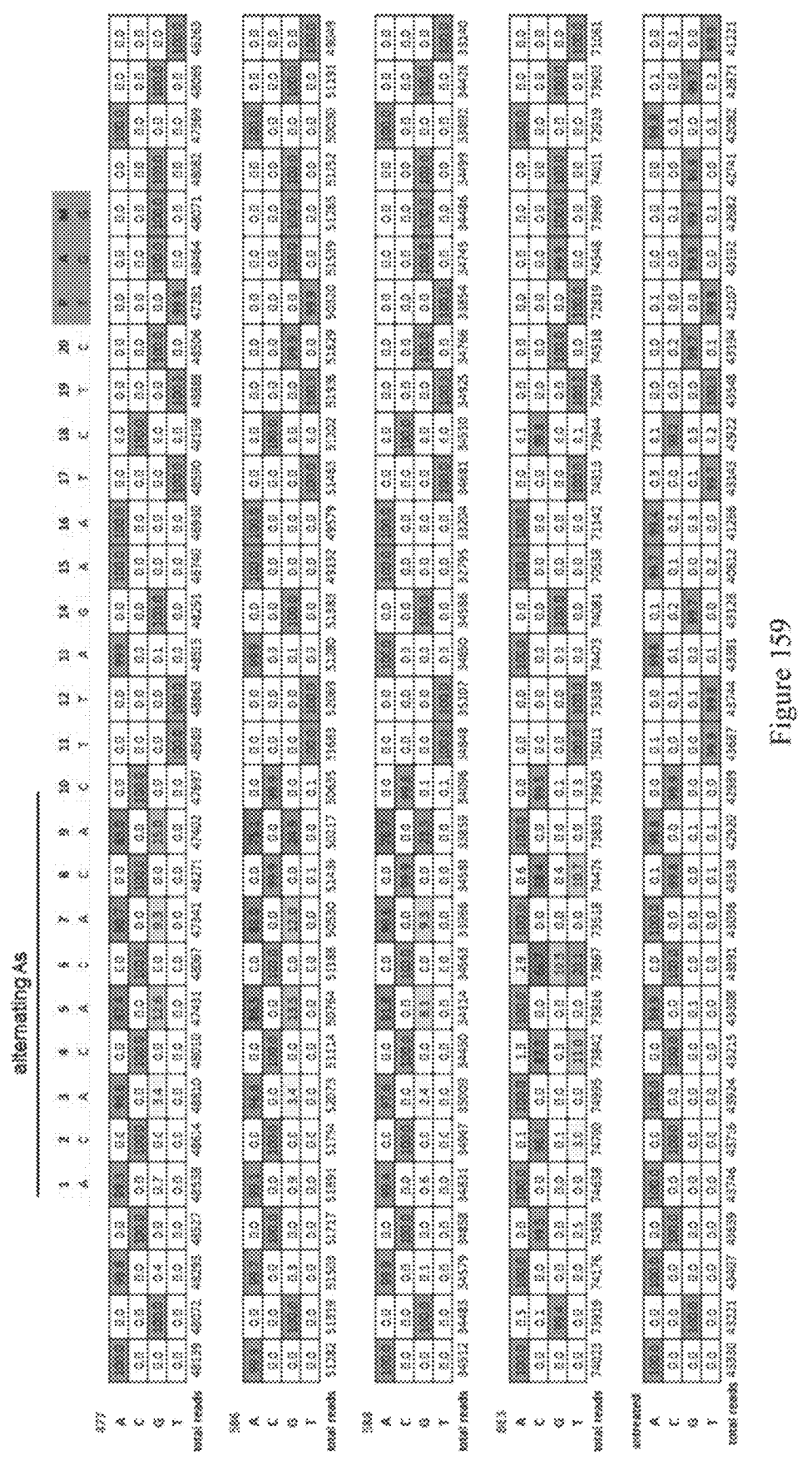

FIG. 159 shows ABE window experiments (A's at odd positions) for identifying which A's are edited. ABEs pNMG-477, pNMG-586, pNMG-588, BE3 and untreated control are shown. The sequence for editing is shown at the top. The sequence corresponds to SEQ ID NO: 562.

Figure 160:
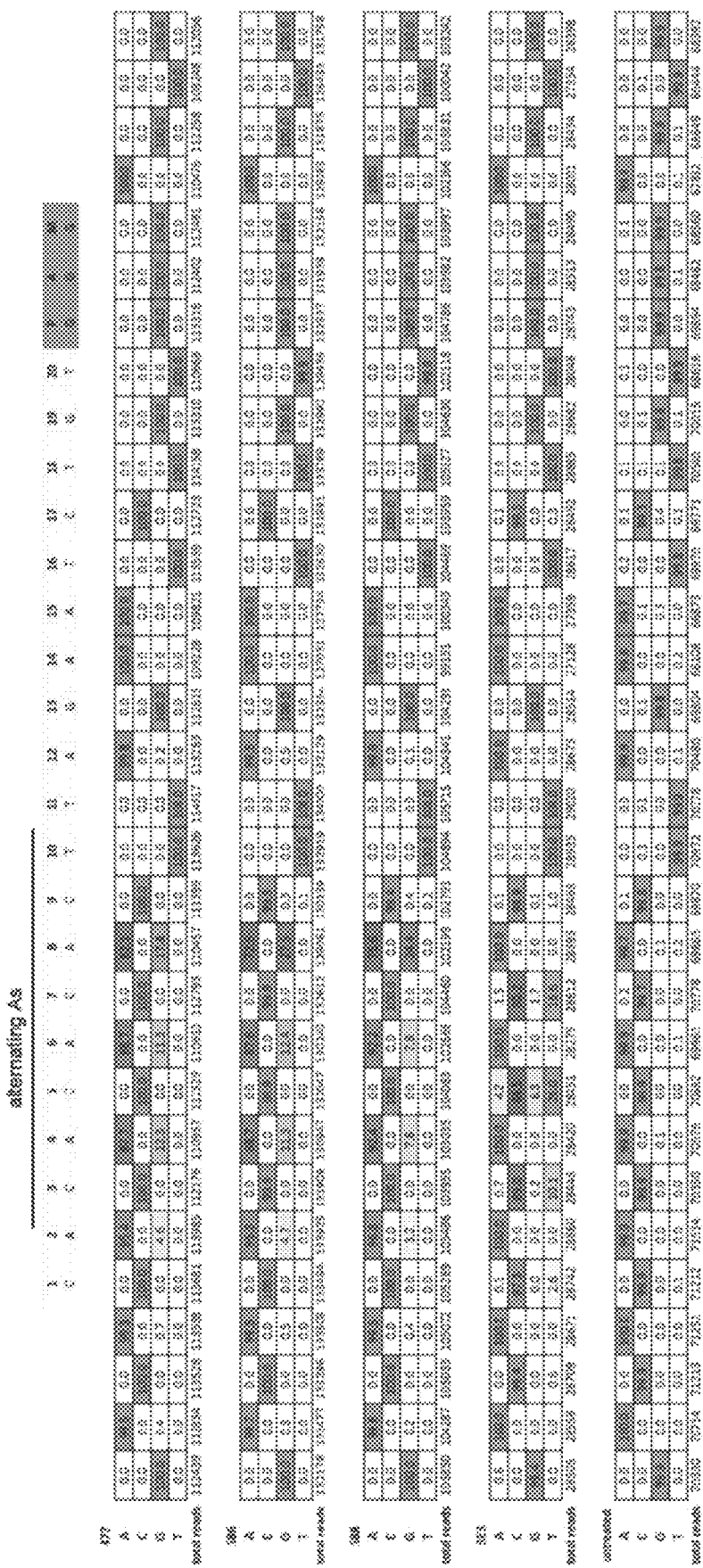

FIG. 160 shows ABE window experiment (A's at even positions) for identifying which A's are edited. ABEs pNMG-477, pNMG-586, pNMG-588, BE3 and untreated control are shown. The sequence for editing is shown at the top. The sequence corresponds to SEQ ID NO: 563.

Figure 161:
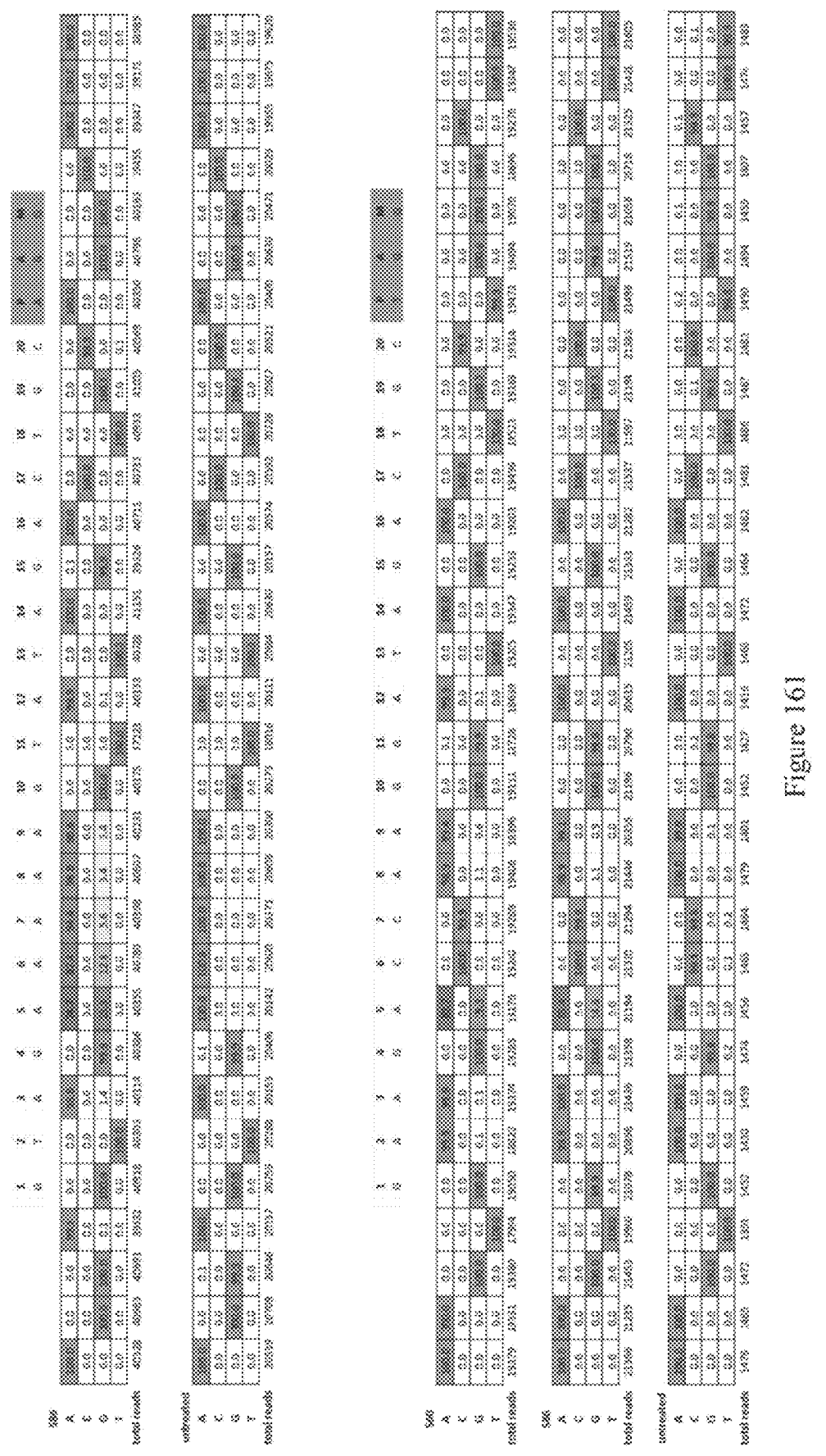

FIG. 161 shows additional ABE window experiments for identifying which A's are edited. ABEs pNMG-586, pNMG-560, and untreated control are shown. The sequence for editing is shown at the top. The sequences correspond to SEQ ID NOs: 544 and 541 from top to bottom, respectively.

Figure 162:
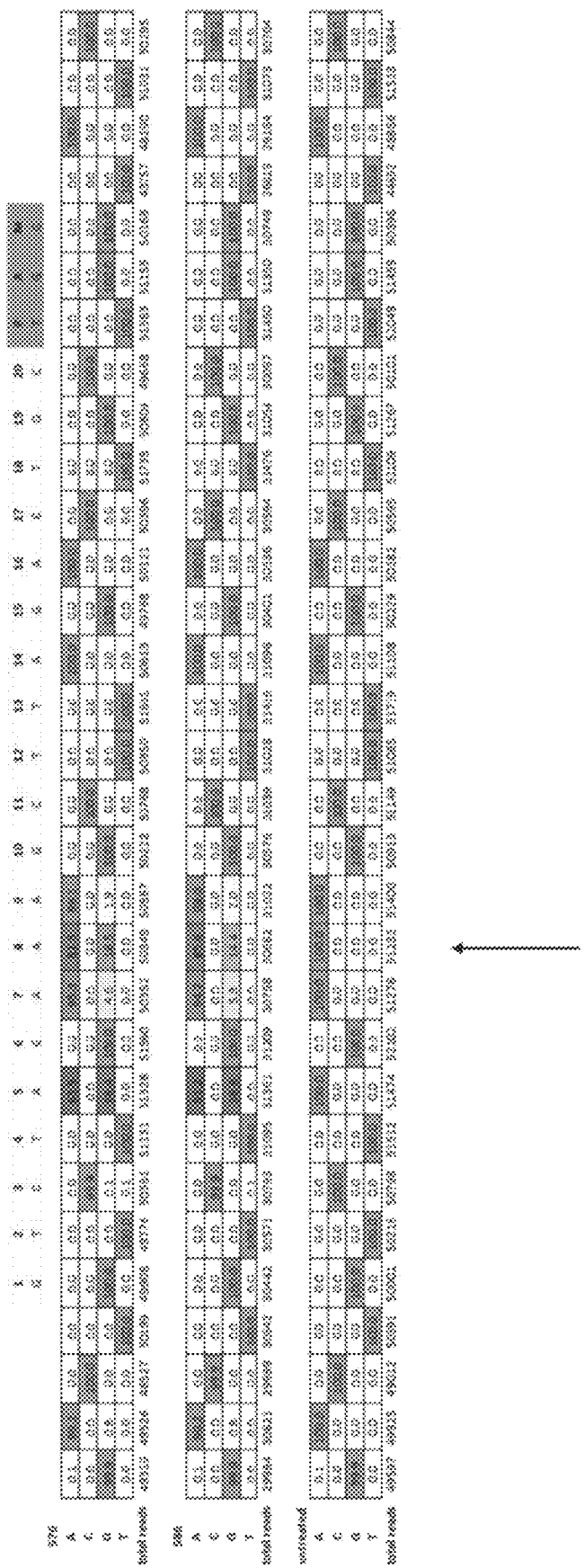

FIG. 162 shows additional ABE window experiments for identifying which A's are edited. ABEs pNMG-576, pNMG-586, and untreated control are shown. The sequence for editing is shown at the top. The sequence corresponds to SEQ ID NO: 564.

FIG. 163 shows evolution #7 an attempt to edit a multi-A site. The evolution selection design was to target 2 point mutations in the same gene using two separate gRNAs: 5'-TTCATTA(7)ACTGTGGCCGGCT-3'(SEQ ID NO: 565) and 5'-ATCTTA(6)TTCGATCATGCGAA-3' (SEQ ID NO: 566) in order to make a D208N reversion mutation in Kan and to revert a stop codon to a Q.

Figure 164:
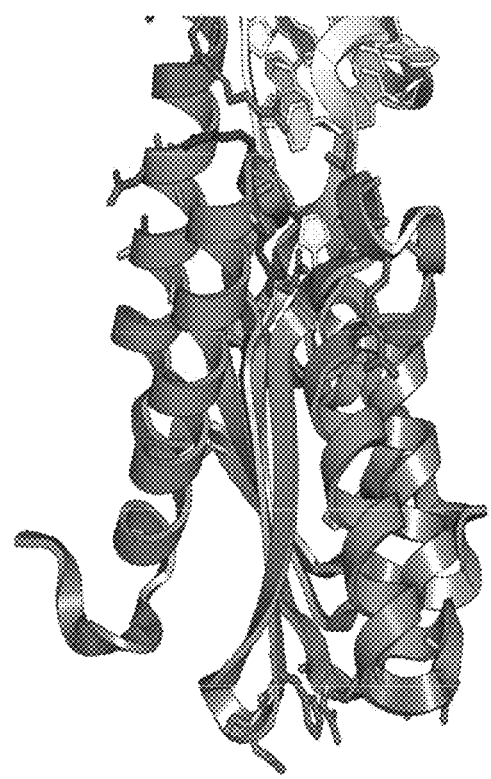

FIG. 164 shows evolution #7 mutations which were evolved to trget As within a multi A site, meaning that they are flanked on one or both sides by an A. The identity of mutations, relative to SEQ ID NO: 1 are shown.

Figure 165:
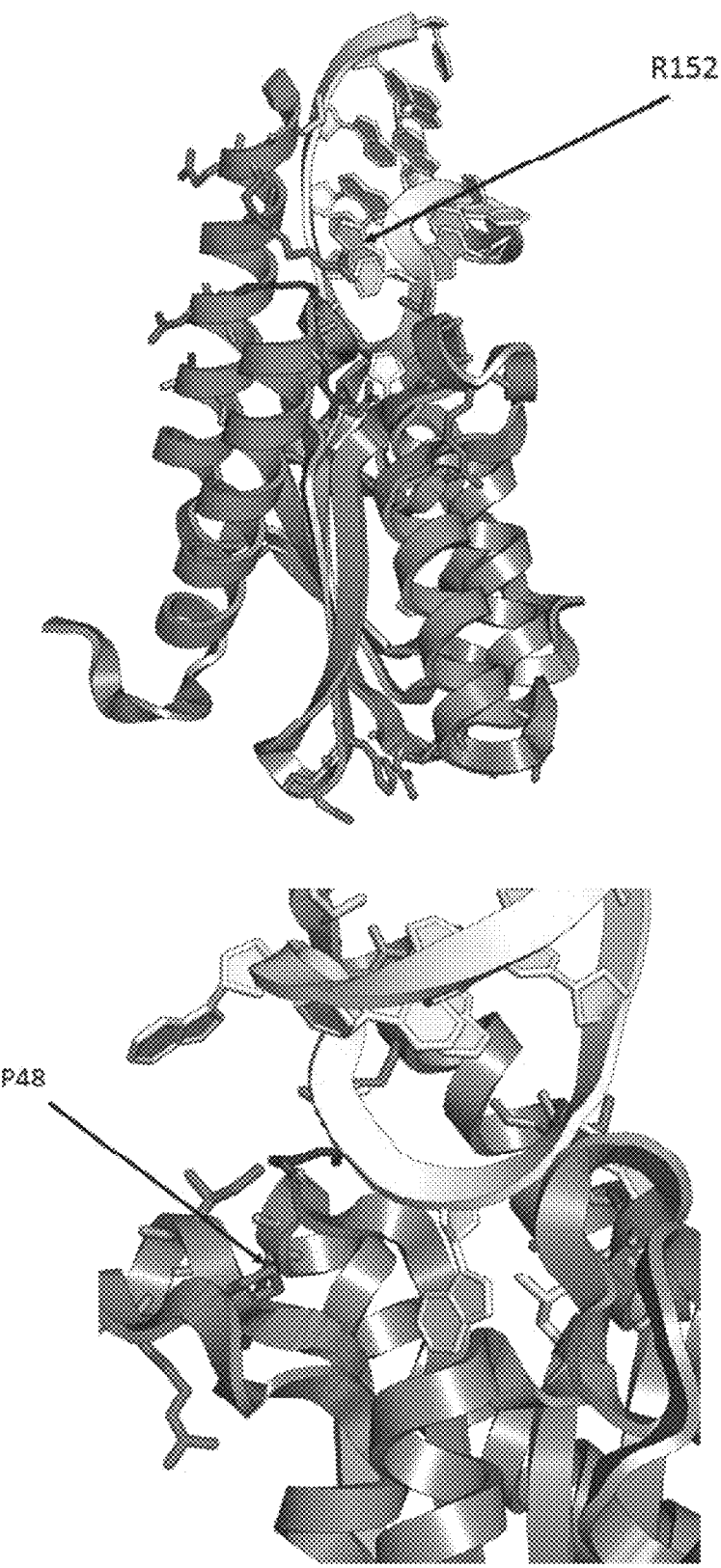

FIG. 165 shows schematics of ecTadA identifying residues R152 and P48.

FIG. 166 shows MiSeq results of ABE editing on disease relevant mutations in alternative cell lines. Nucleofection with Lonza kit was used with 3 different nucleofection solutions×16 different electroporation conditions (48 total conditions/cell line). The sequences correspond to SEQ ID NOs: 522-524 from top to bottom, respectively.

Figure 167:
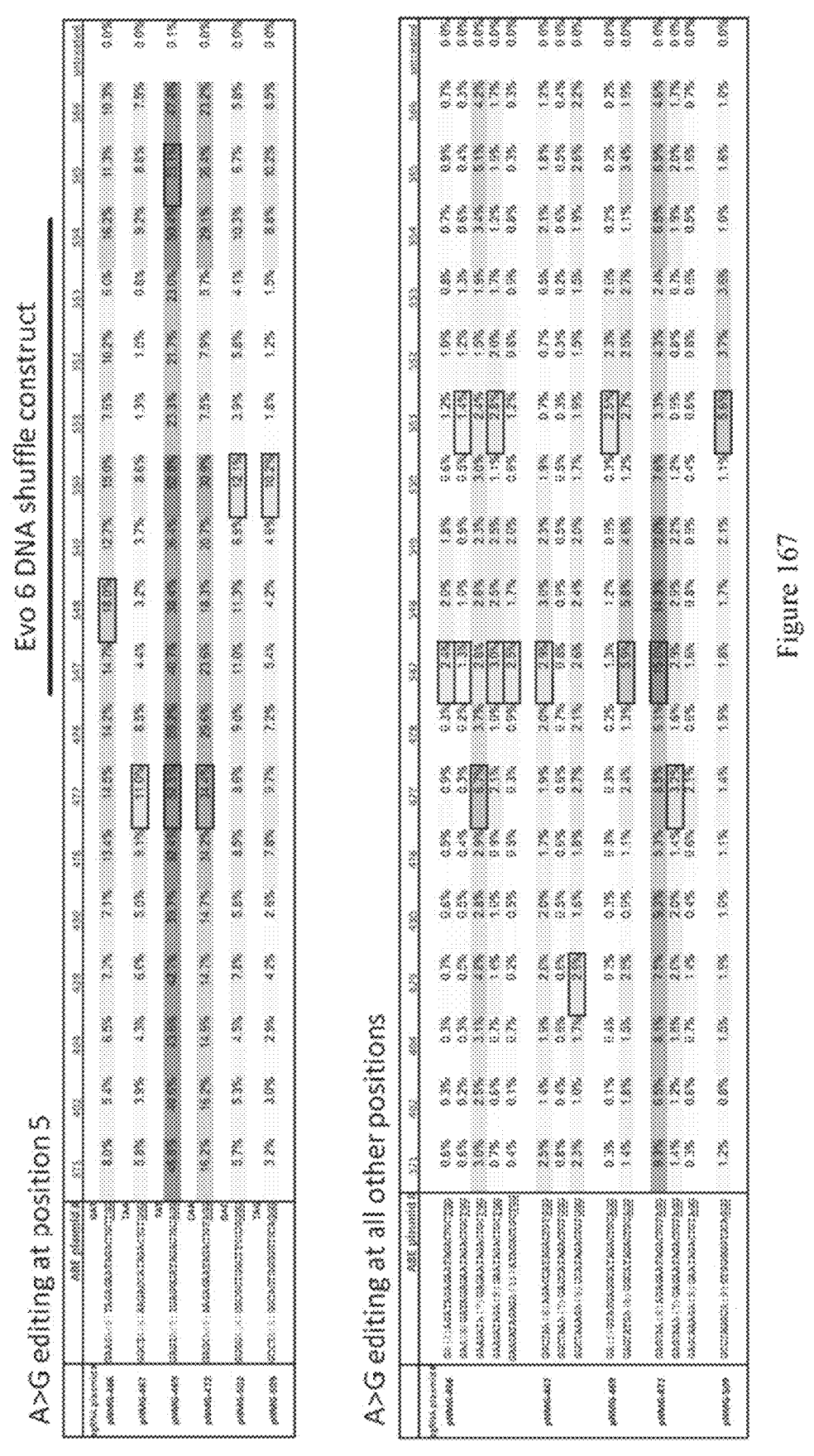

FIG. 167 shows results for A to G editing at multiple positions for various constructs. ABE constructs are indicated by their pNMG reference numbers as shown in Table 4. In the top panel the sequences correspond to SEQ ID NOs: 469-471, 567, 475, and 474 from top to bottom, respectively. In the bottom panel the sequences correspond to SEQ ID NOs: 469 (pNMG-466), 470 (pNMG-467), 471 (pNMG-469), 567 (pNMG-472), and 474 (pNMG-509) from top to bottom, respectively.

Figure 168:
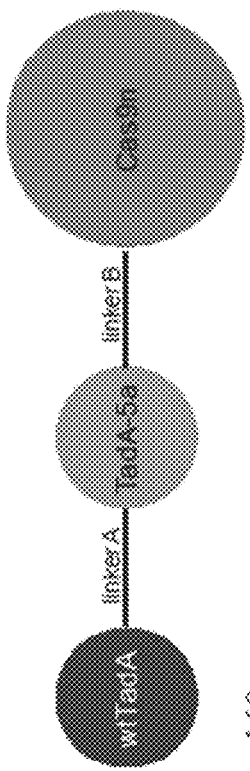

FIG. 168 shows editing results for various constructs using ABEs with different linkers. ABE constructs are indicated by their pNMG reference numbers as shown in Table 4. A schematic of the new linker ABE is also shown. The sequences correspond to SEQ ID NOs: 469 (pNMG-466), 568 (pNMG-468), 471 (pNMG-469), 567 (pNMG-472), 574 (pNGM-509), and 569) (pNMG-539) from top to bottom, respectively.

Figure 169:
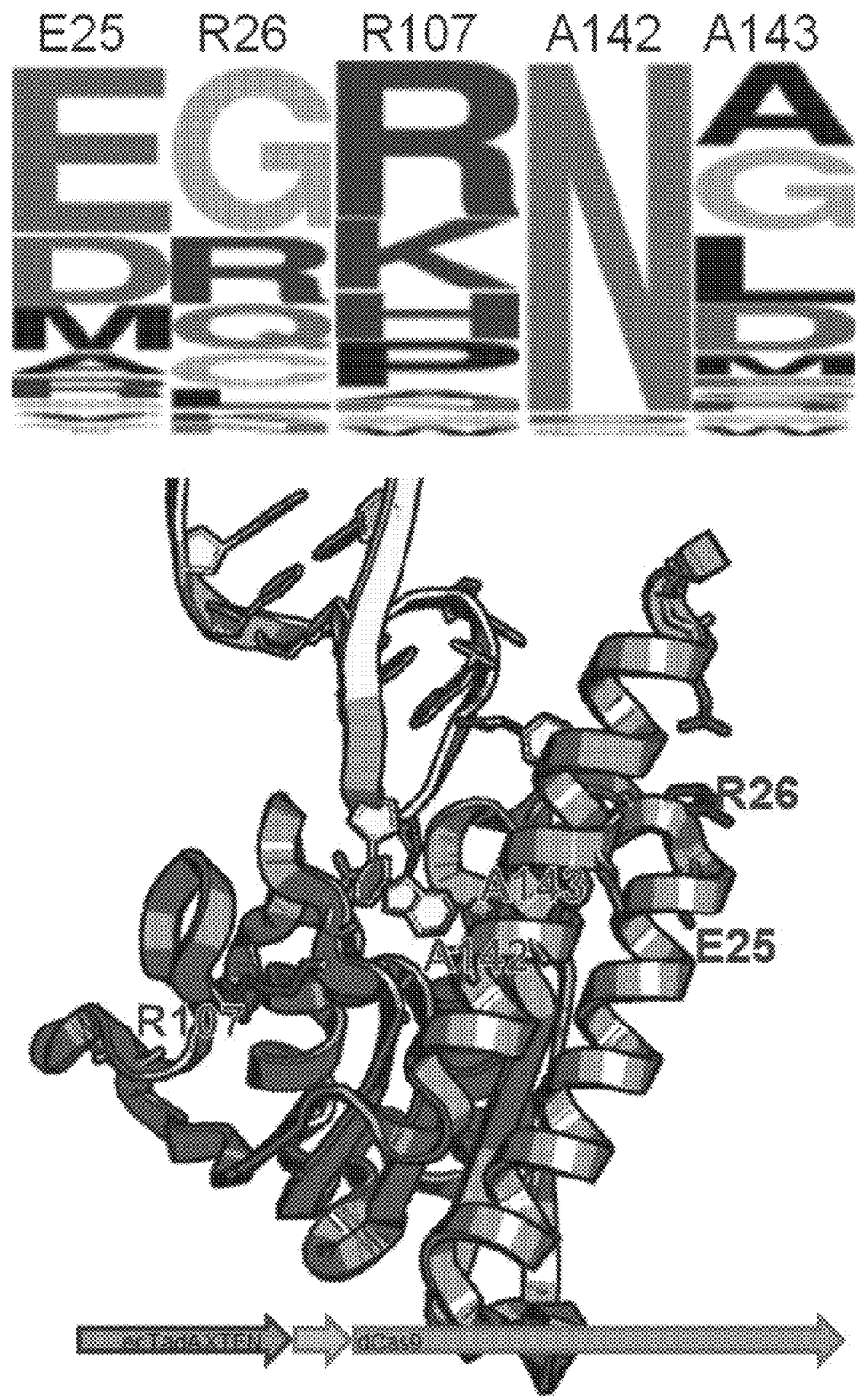

FIG. 169 shows the 4$^{th}$ round evolution. Evolution was done with a monomer construct and endogenous TadA complements TadA-dCas9 fusion.

Figure 170:
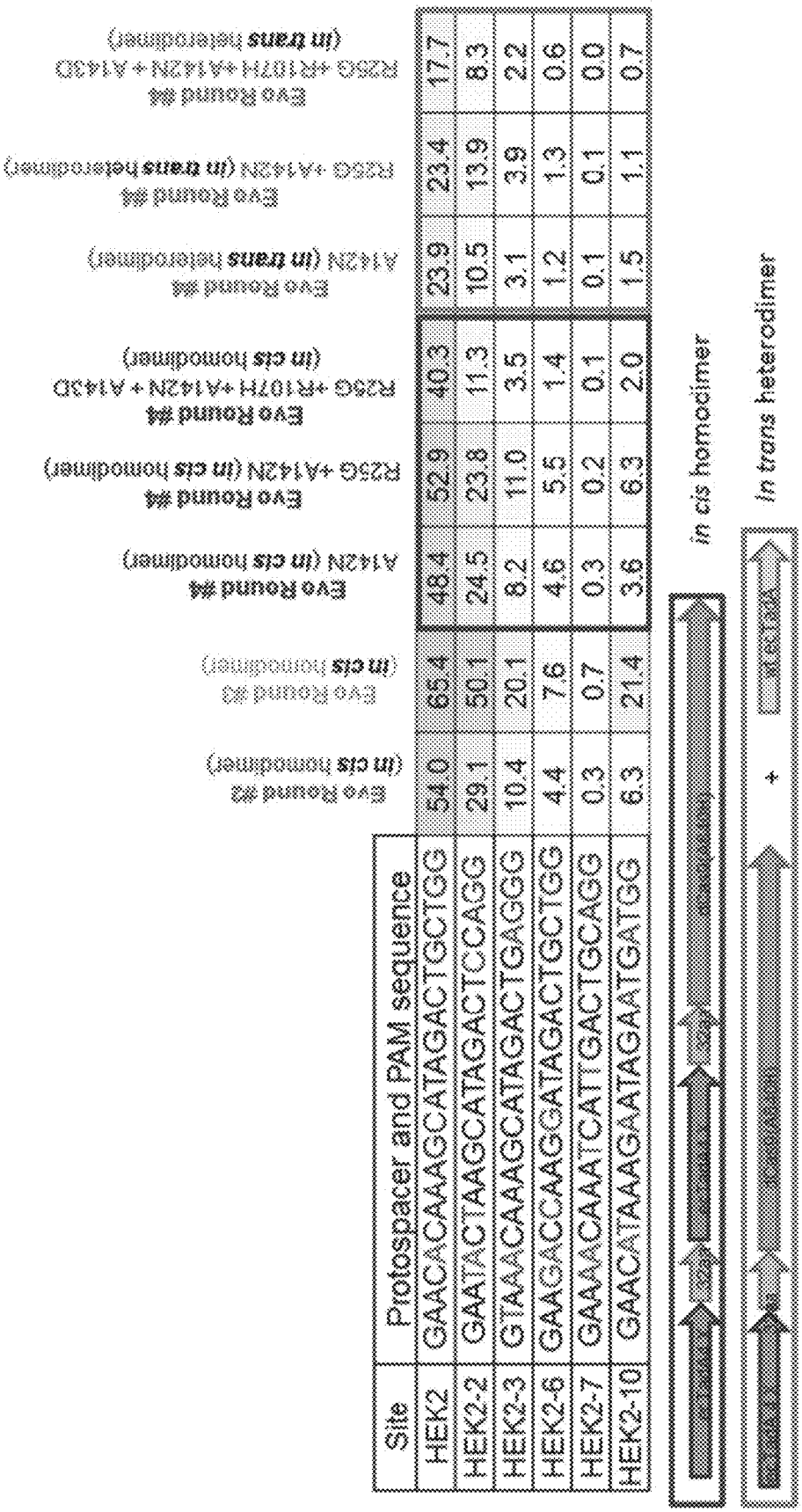

FIG. 170 shows 4$^{th}$ round evolution results. The sequences correspond to SEQ ID NOs: 7, 368, 363, 364, 369, and 370 from top to bottom, respectively.

Figure 171:
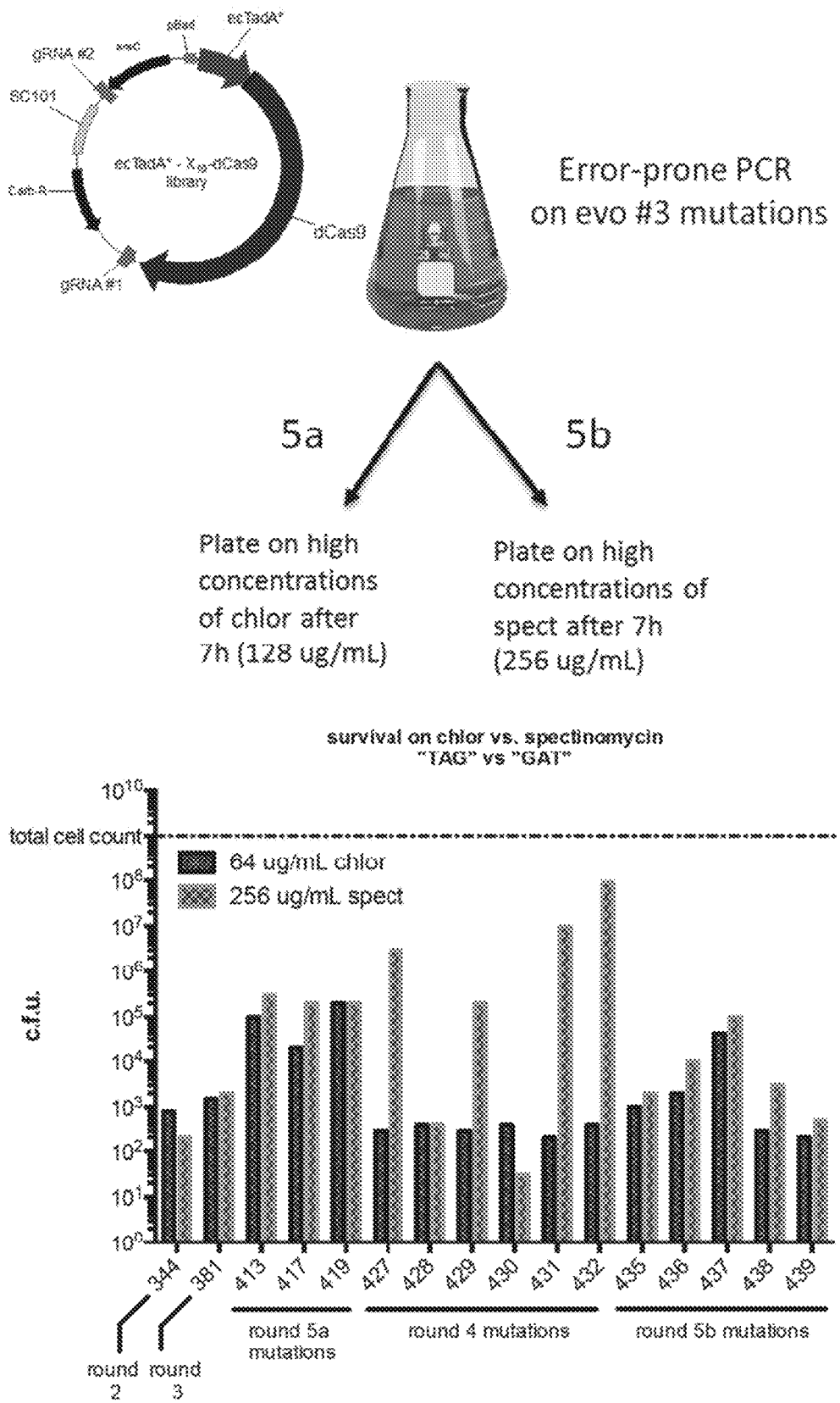

FIG. 171 shows evolution round #5. The plasmid and experimental outline are shown (top panel). The graph illustrates survival on chlor vs. spectinomycin "TAG" vs. "GAT." The chlor target sequence is 5'-TACGGCGTAGTGCACCTGGA-3' (SEQ ID NO: 441) and the aspect target sequence is 5'-CAATGATGACTTC-TACAGCG-3'(SEQ ID NO: 444).

Figure 172:
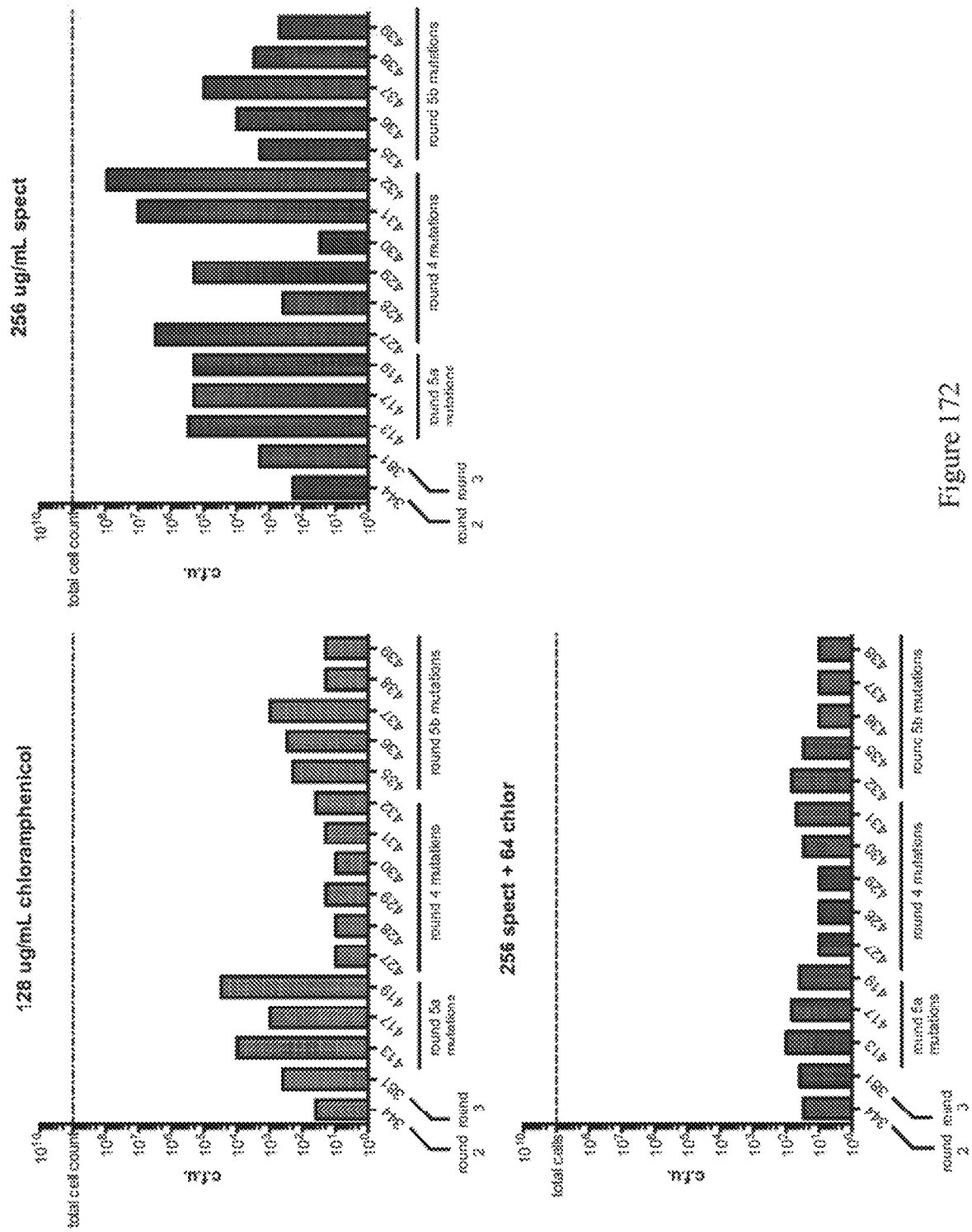

FIG. 172 shows editing results at the chlor and spect sites. Constructs identified from evolution #4 (site saturated/NNK library) appear edit more efficiently on the spect site rather than on the chor site. ABE constructs are indicated by their pNMG reference numbers as shown in Table 4.

Figure 173:
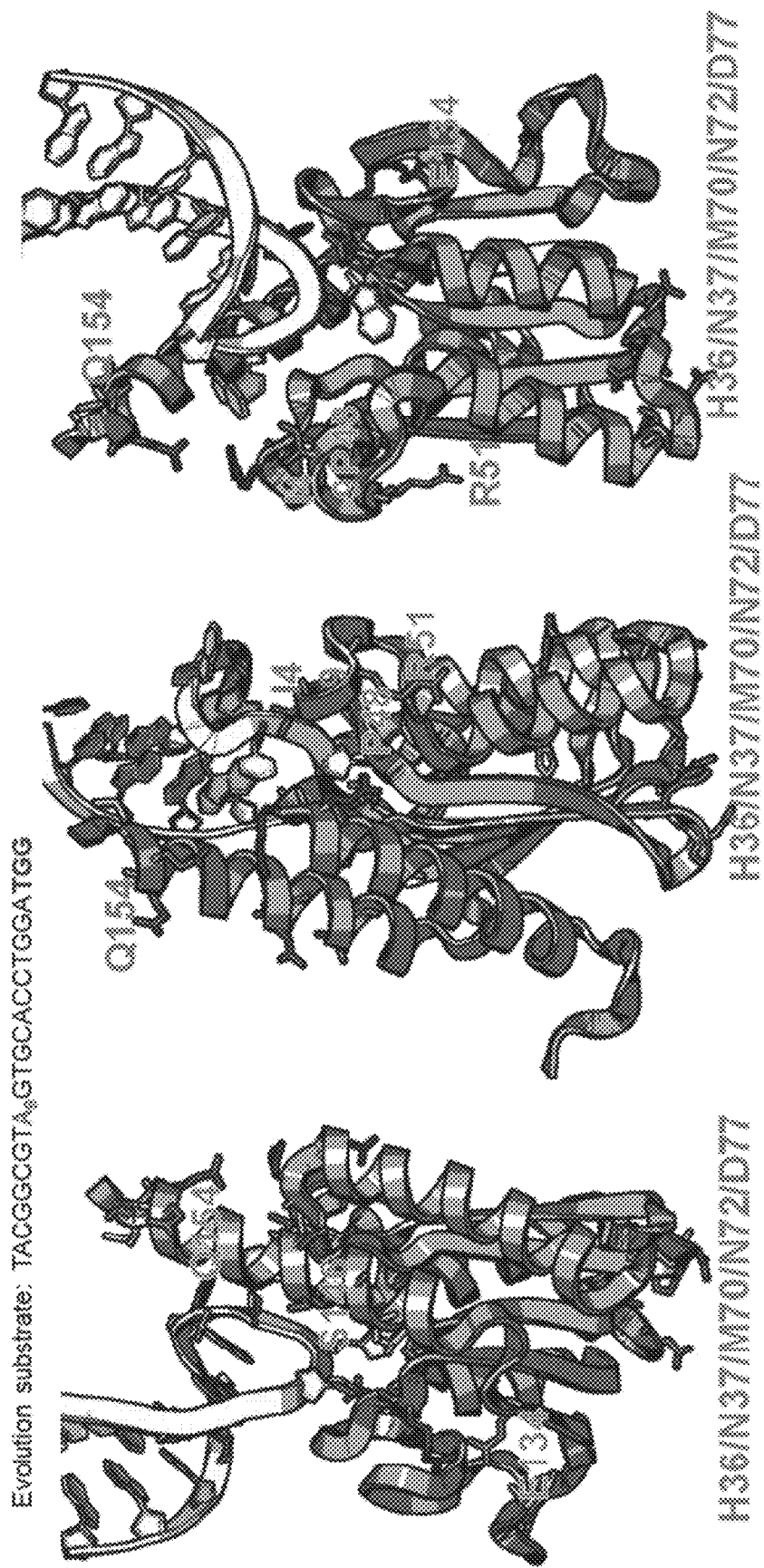

FIG. 173 shows 5$^{th}$ round evolution (part a). The sequence corresponds to SEQ ID NO: 570.

Figure 174:
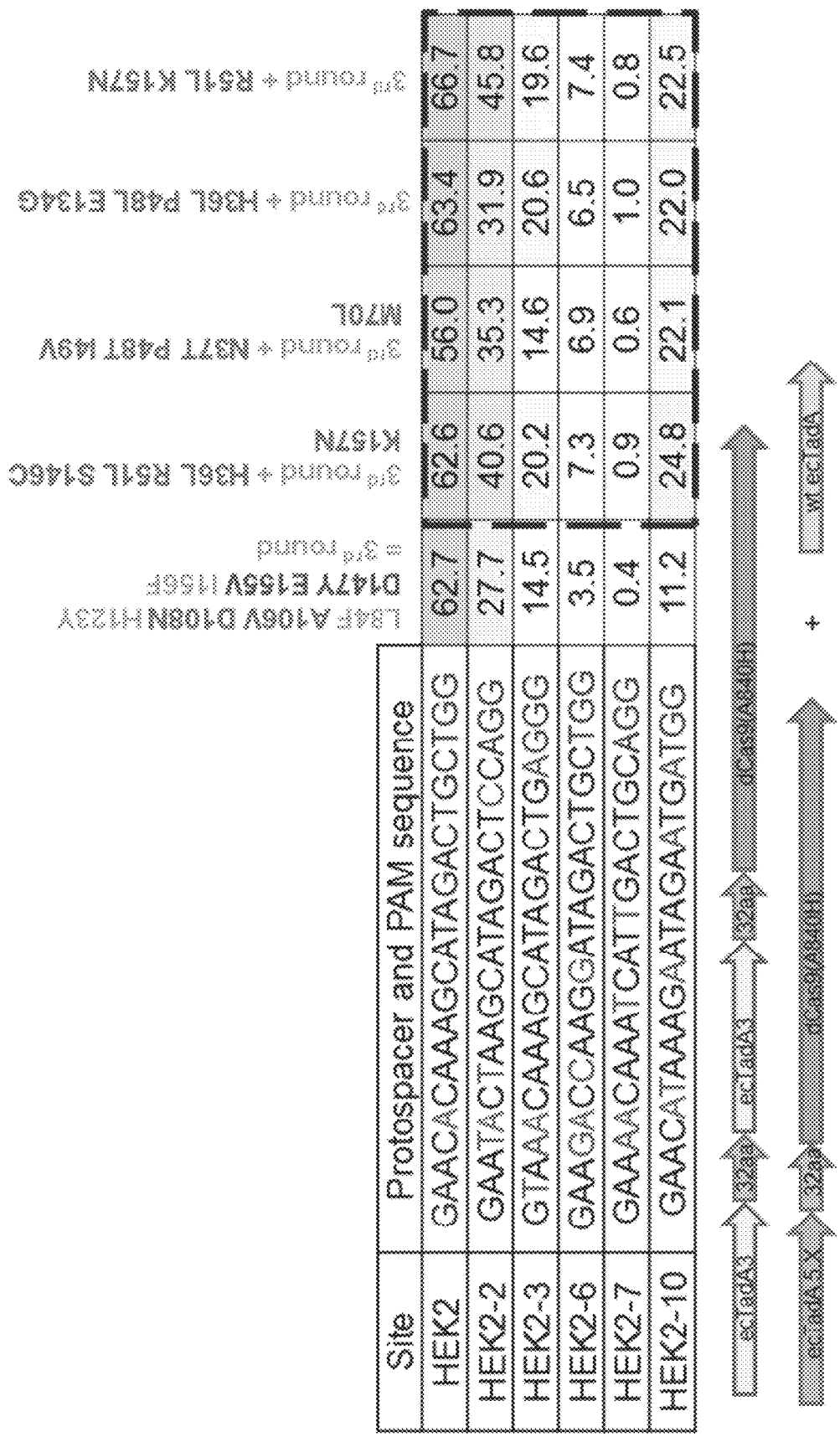

FIG. 174 shows 5$^{th}$ round heterodimer (in trans) results. Round #5a identified mutations improved both editing efficiencies and broadened substrate specificity. The sequences correspond to SEQ ID NOs: 7, 368, and 363, 364, 369, and 370 from top to bottom, respectively.

Figure 175:
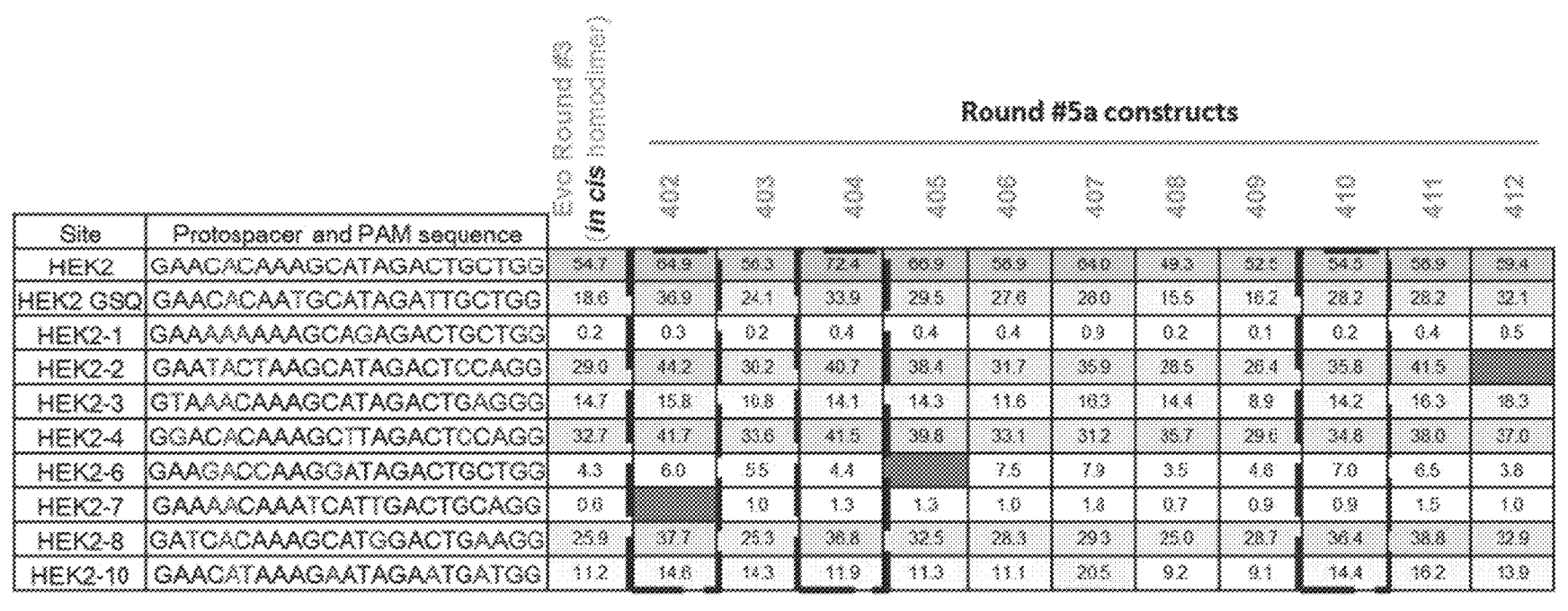

FIG. 175 shows 5$^{th}$ round heterodimer (in cis) results. Round #5a identified mutations improved both editing efficiencies and broadened substrate specificity, but the cis results gave higher editing efficiencies. ABE constructs are indicated by their pNMG reference numbers as shown in Table 4. The sequences correspond to SEQ ID NOs: 7, 571, 465, 368, 363, 466, 364, 369, 572, and 370 from top to bottom, respectively.

Figure 176:
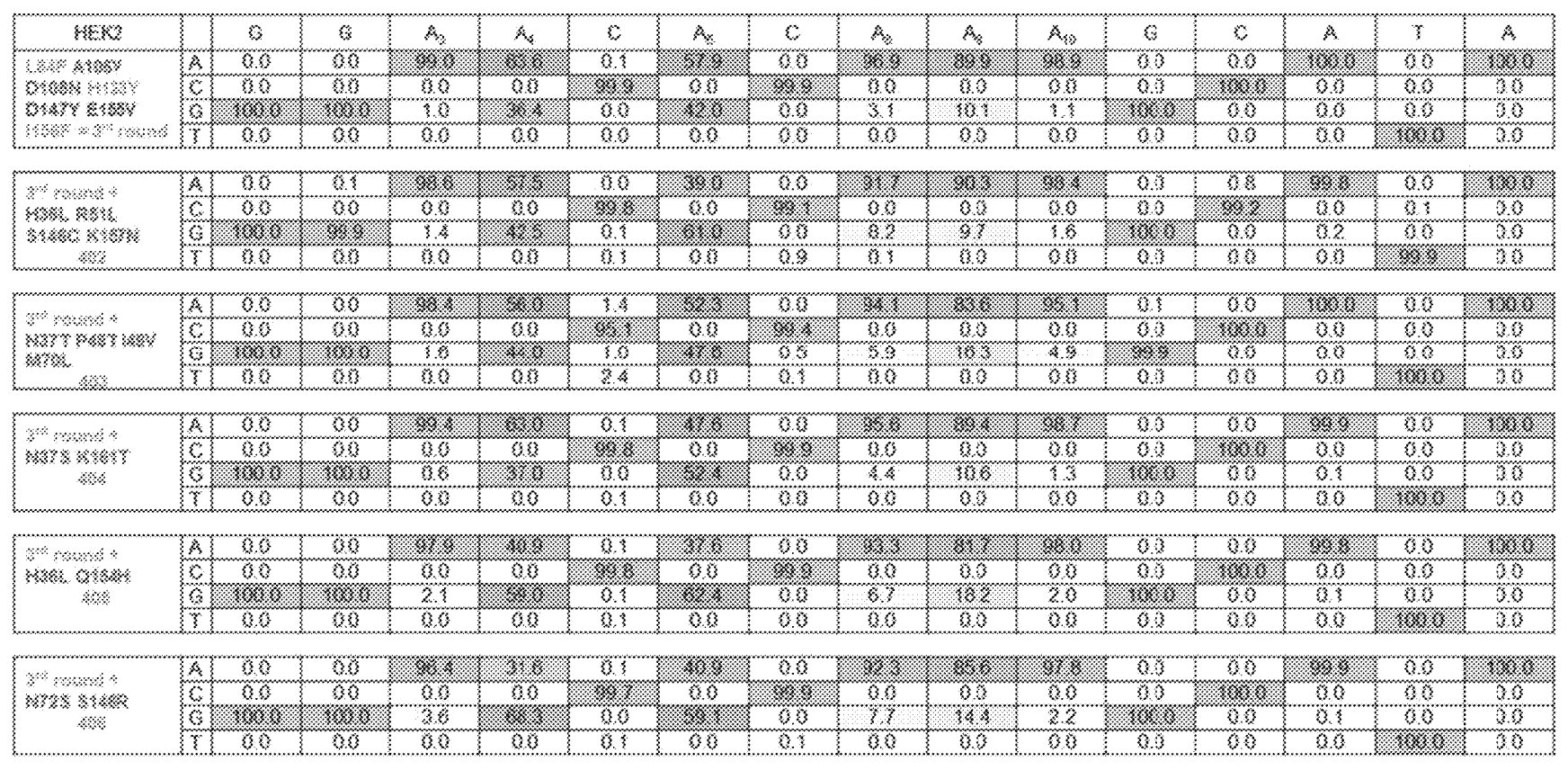

FIG. 176 shows editing results of various constructs for evolution 5.

Figure 177:
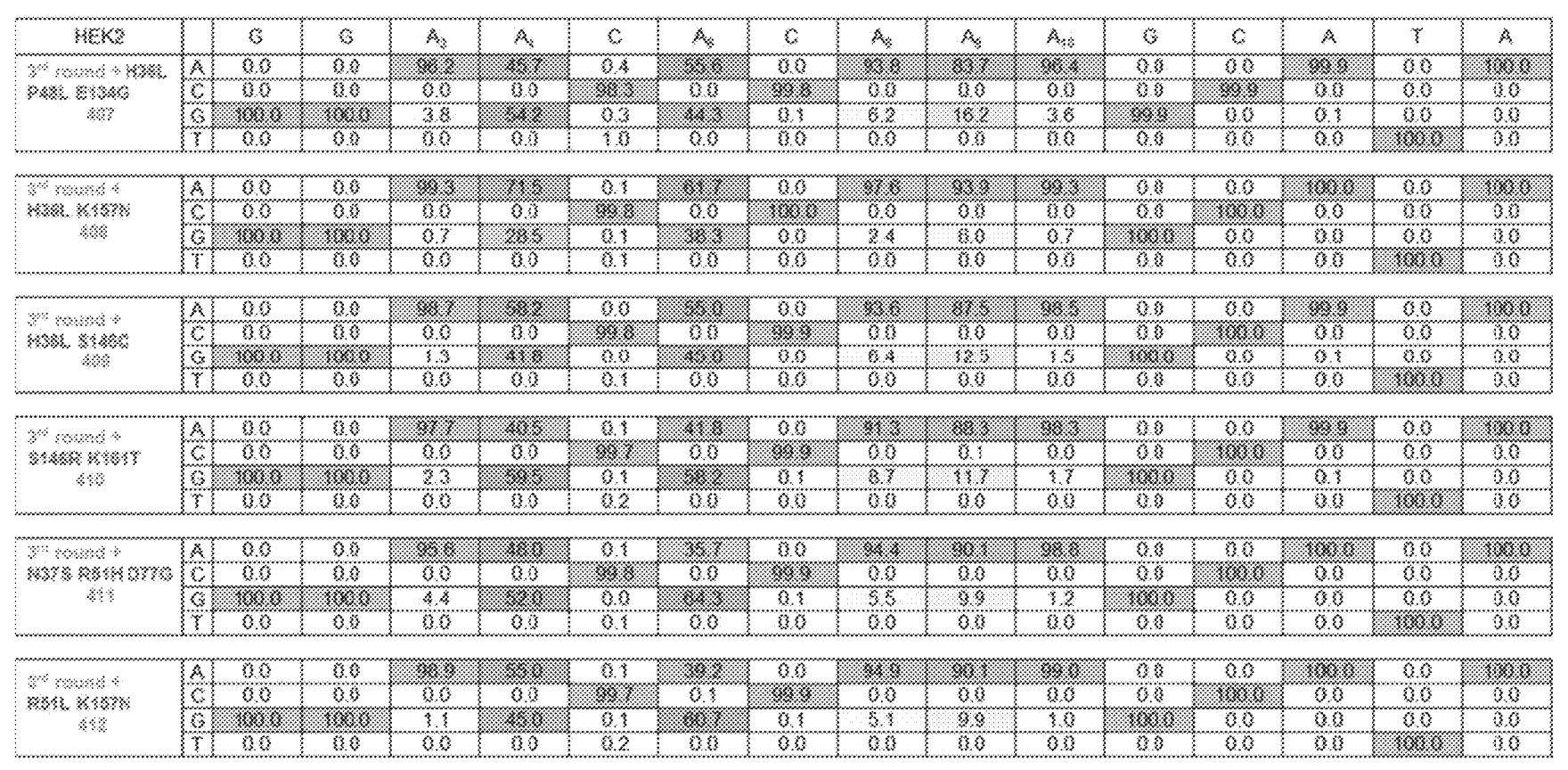

FIG. 177 shows editing results of various constructs for evolution 5.

FIG. 178 shows gRNAs for ABE. 5a constructs are characterized on all 16 NAN sequences A at position 5 in protospacer (left panel). The sequences correspond to SEQ ID NOs: 573-578 from top to bottom, respectively. Additional sequences starting with a "G" in order to minimize variations in yield gRNA synthesis are proposed (right panel). The sequences correspond to SEQ ID NOs: 579-588 from top to bottom, respectively.

FIG. 179 shows % A to G editing of $A_5$ using sgRNA 299 as indicated in Table 8 and the ABE constructs, which are indicated by their pNMG reference numbers as shown in Table 4. The sequence corresponds to SEQ ID NO: 478.

Figure 180:
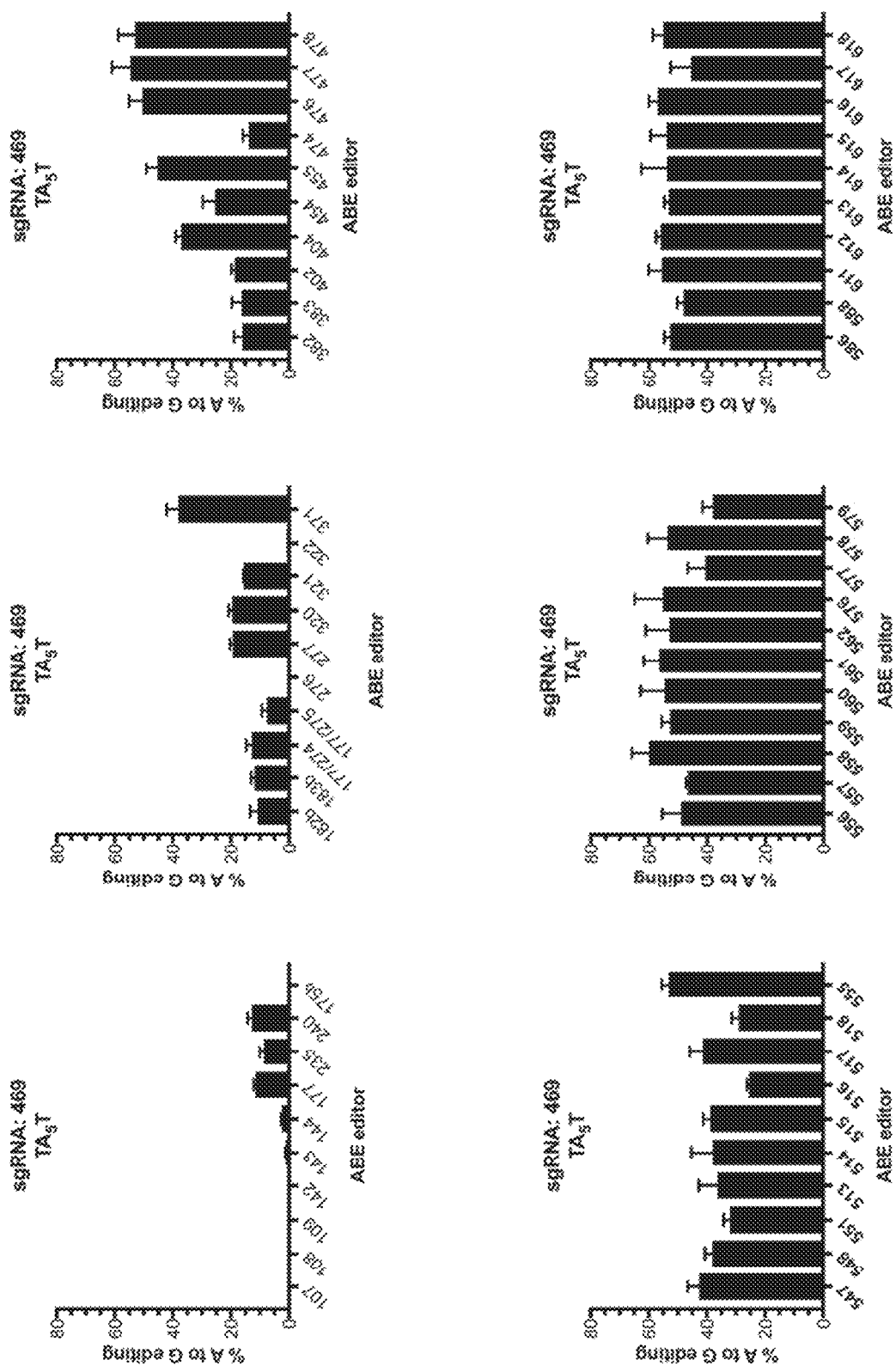

FIG. 180 shows % A to G editing of $A_5$ using sgRNA 469 as indicated in Table 8 and the ABE constructs, which are indicated by their pNMG reference numbers as shown in Table 4. The sequence corresponds to SEQ ID NO: 509.

Figure 181:
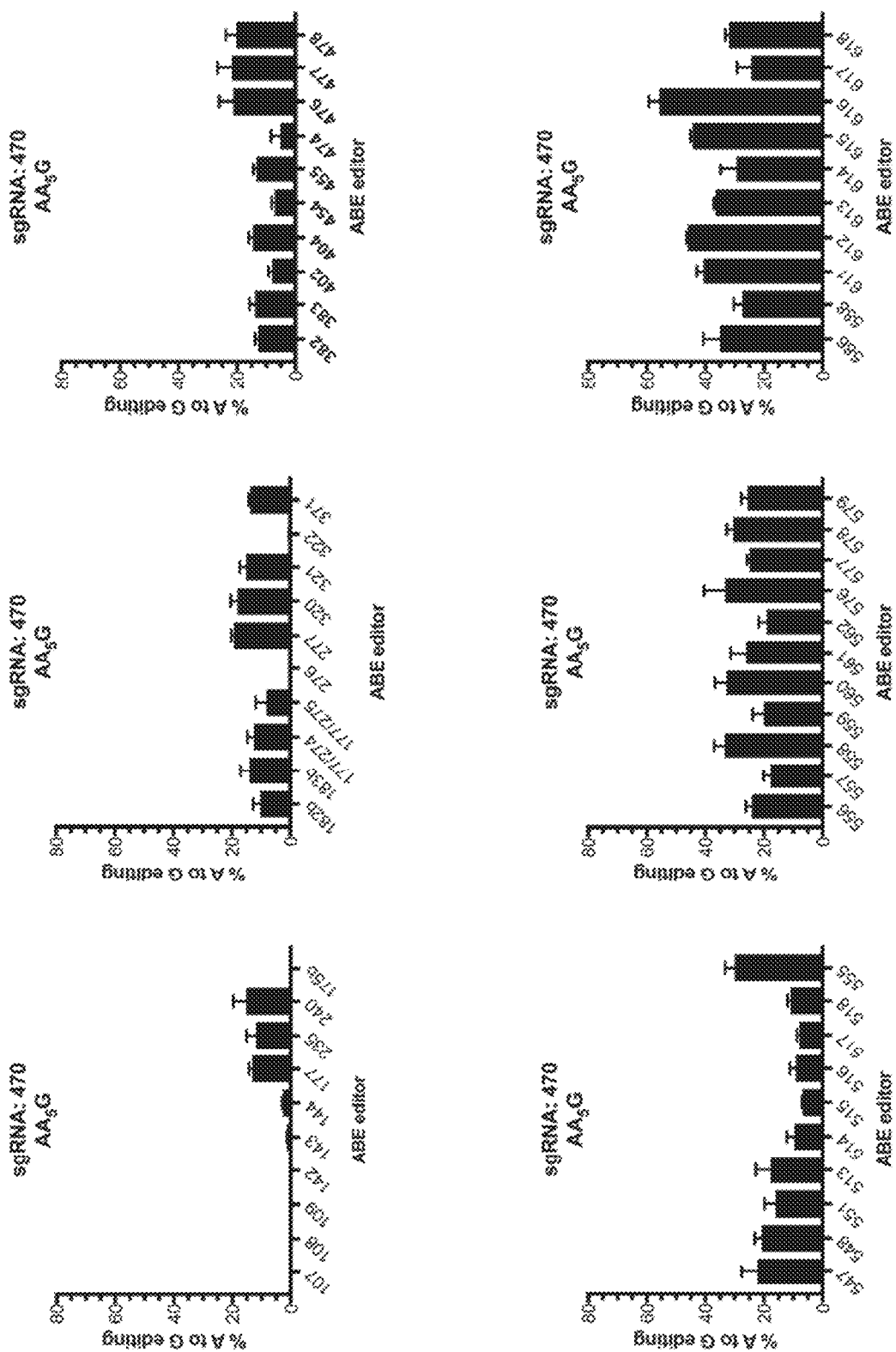

FIG. 181 shows % A to G editing of $A_5$ using sgRNA 470 as indicated in Table 8 and the ABE constructs, which are indicated by their pNMG reference numbers as shown in Table 4. The sequence corresponds to SEQ ID NO: 510.

Figure 182:
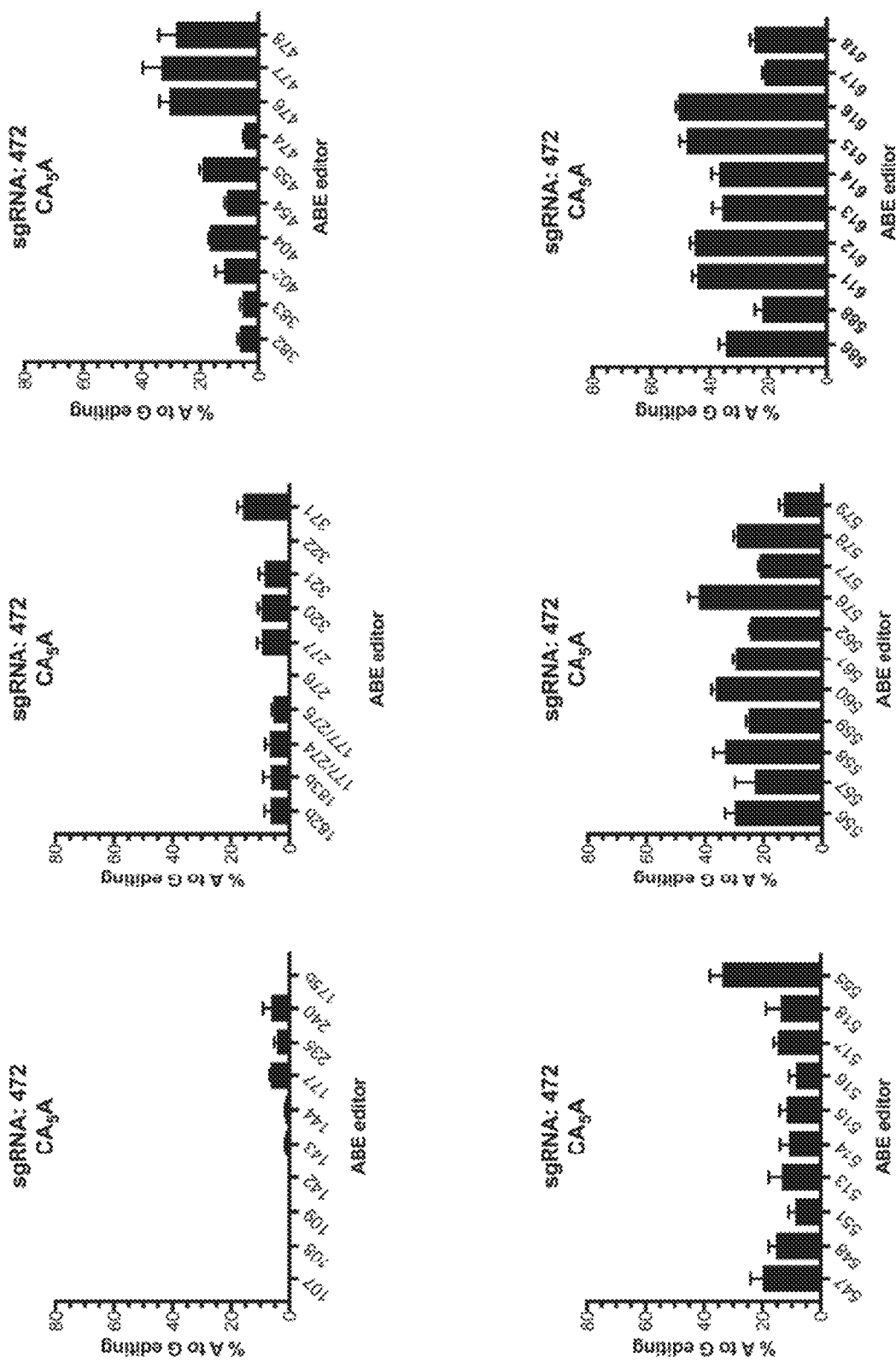

FIG. 182 shows % A to G editing of As using sgRNA 472 as indicated in Table 8 and the ABE constructs, which are indicated by their pNMG reference numbers as shown in Table 4. The sequence corresponds to SEQ ID NO: 512.

Figure 183:
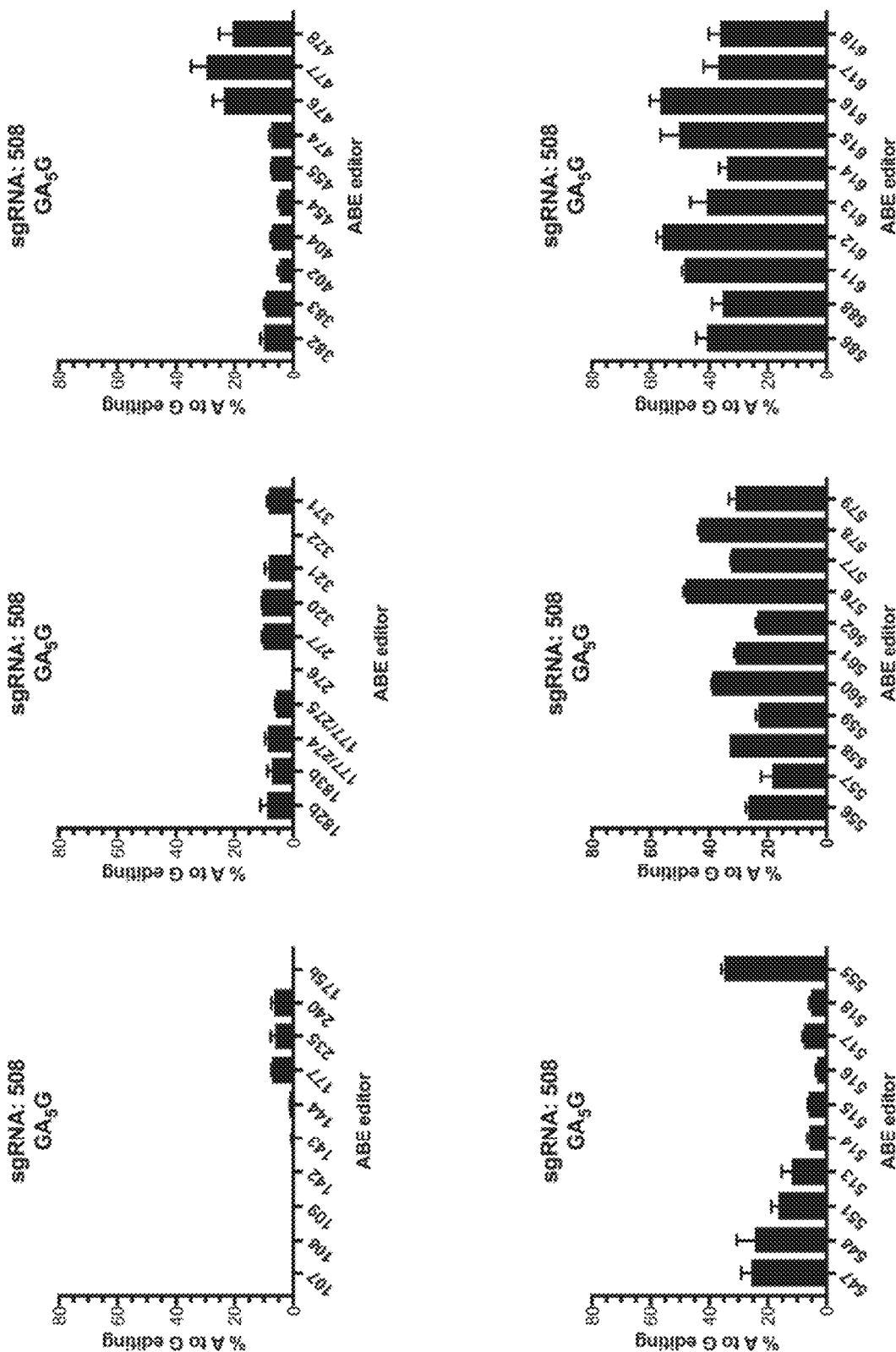

FIG. 183 shows % A to G editing of As using sgRNA 508 as indicated in Table 8 and the ABE constructs, which are indicated by their pNMG reference numbers as shown in Table 4. The sequence corresponds to SEQ ID NO: 520.

Figure 184:
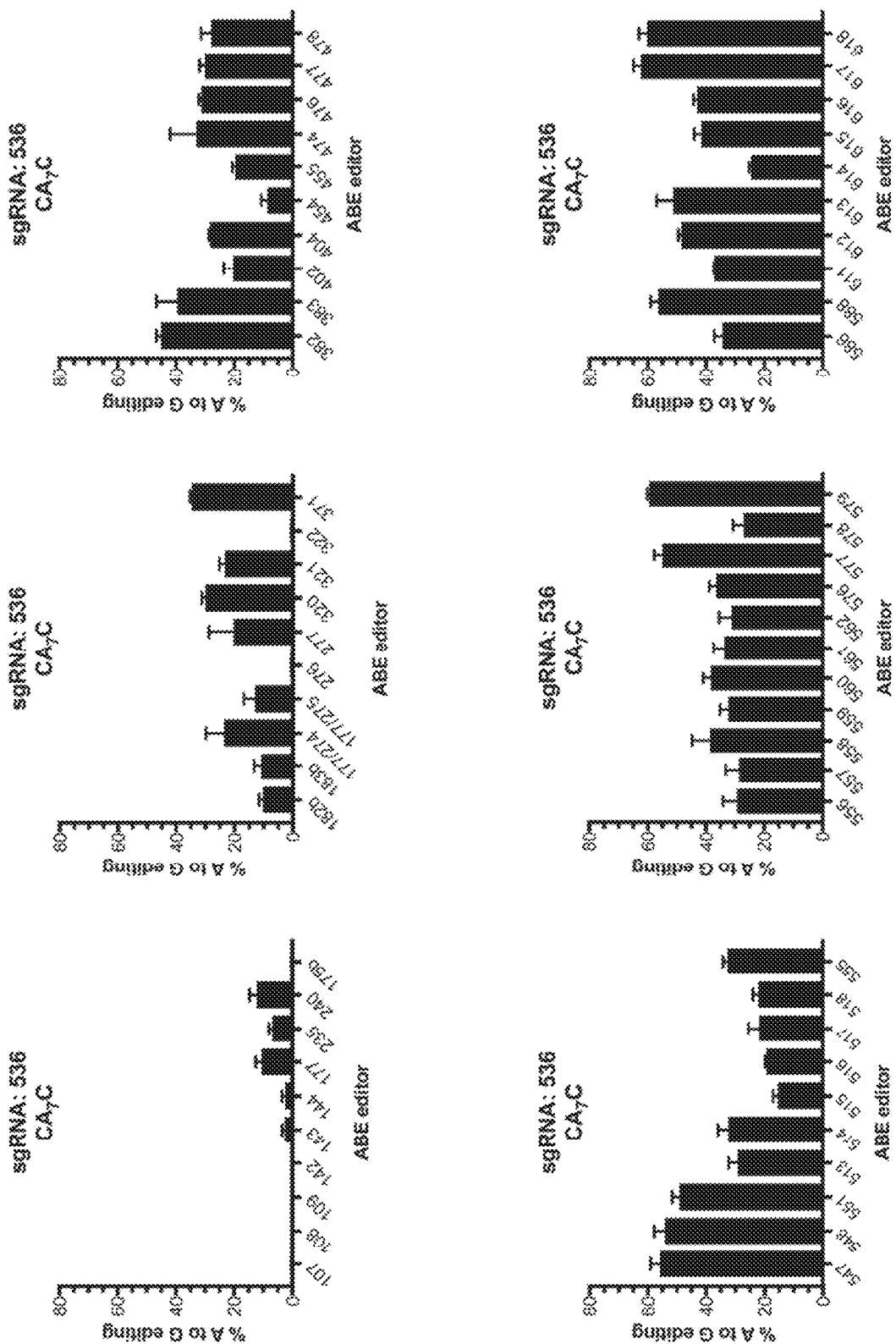

FIG. 184 shows % A to G editing of $A_7$ using sgRNA 536 as indicated in Table 8 and the ABE constructs, which are indicated by their pNMG reference numbers as shown in Table 4. The sequence corresponds to SEQ ID NO: 530.

Figure 185:
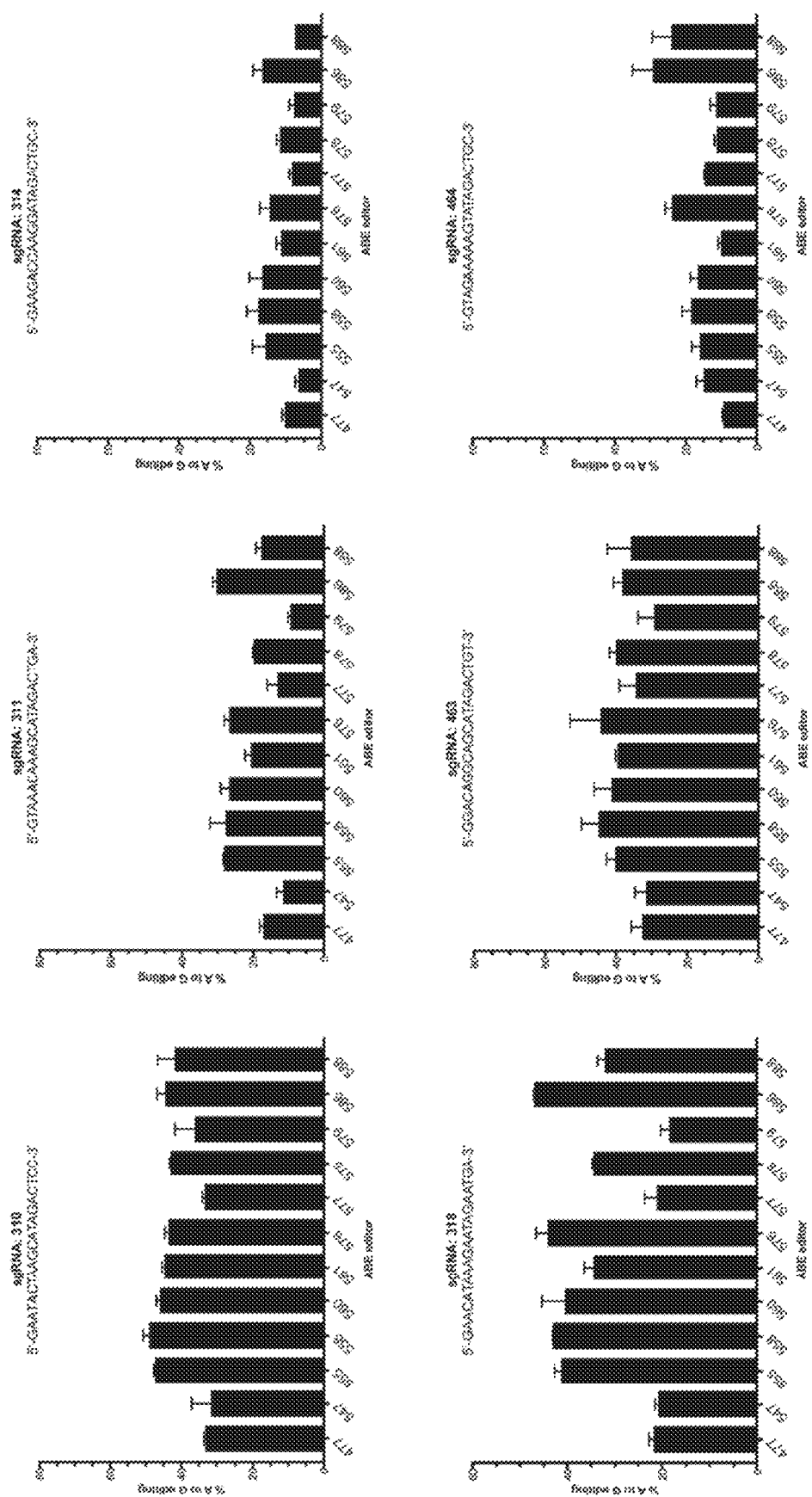

FIG. 185 shows the % of A to G editing of the highlighted A (As) using sgRNA: 310, sgRNA: 311, sgRNA: 314, sgRNA: 318, sgRNA: 463, and sgRNA: 464 for each of the indicated base editors, which are indicated by their pNMG reference numbers as shown in Table 4. The sequences correspond to SEQ ID NOs: 489, 490, 493, 497, 503 and 504 from left to right and top to bottom, respectively.

Figure 186:
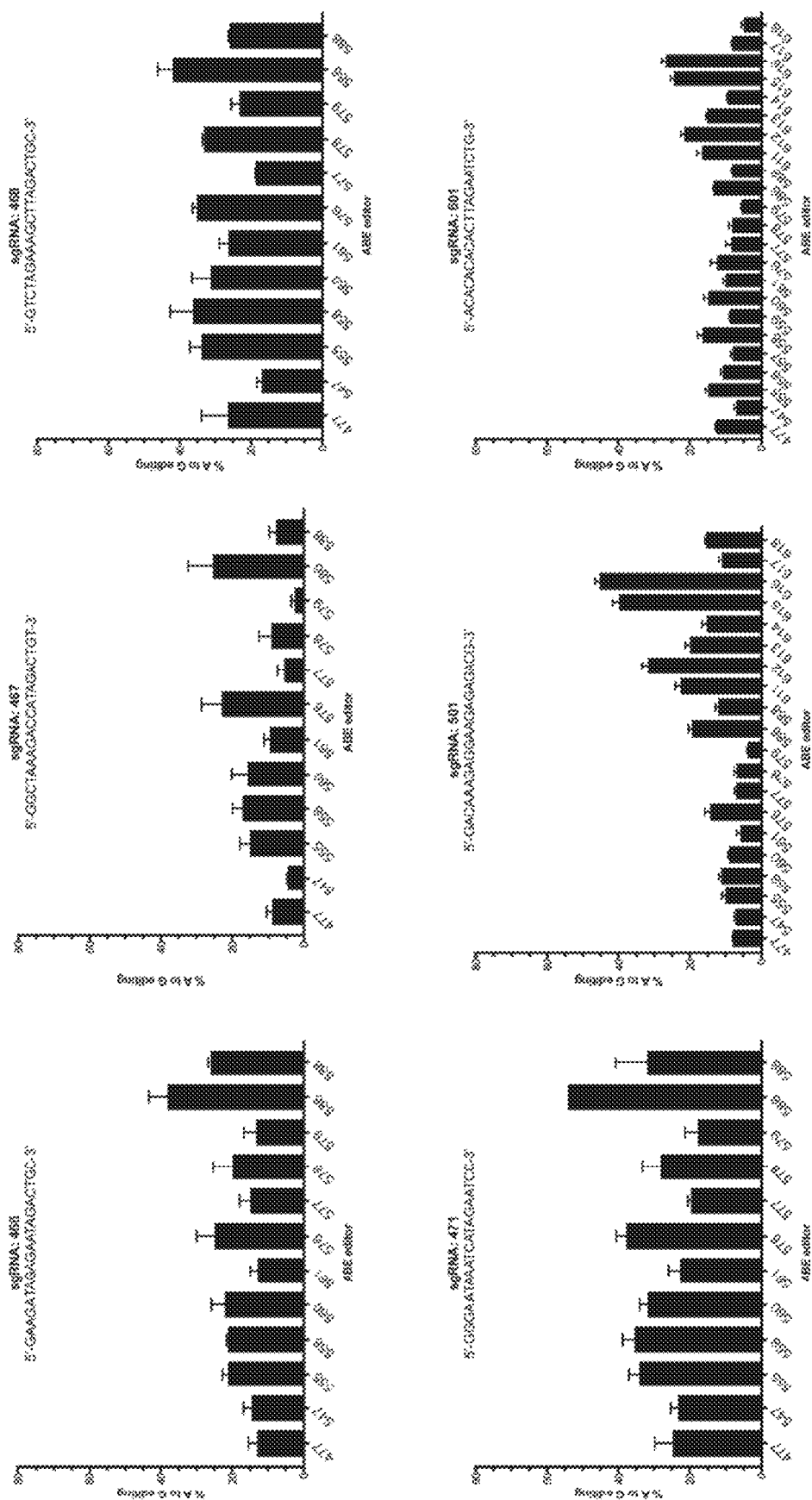

FIG. 186 shows the % of A to G editing of the highlighted A (As) using sgRNA: 466, sgRNA: 467, sgRNA: 468, sgRNA: 471, sgRNA: 501, and sgRNA: 601 for each of the indicated base editors, which are indicated by their pNMG reference numbers as shown in Table 4. The sequences correspond to SEQ ID NOs: 506, 507, 508, 511, 513, and 535 from left to right and top to bottom, respectively.

DEFINITIONS

As used herein and in the claims, the singular forms "a," "an," and "the" include the singular and the plural unless the context clearly indicates otherwise. Thus, for example, a reference to "an agent" includes a single agent and a plurality of such agents.

The term "deaminase" or "deaminase domain" refers to a protein or enzyme that catalyzes a deamination reaction. In some embodiments, the deaminase is an adenosine deaminase, which catalyzes the hydrolytic deamination of adenine or adenosine. In some embodiments, the deaminase or deaminase domain is an adenosine deaminase, catalyzing the hydrolytic deamination of adenosine or deoxyadenosine to inosine or deoxyinosine, respectively. In some embodiments, the adenosine deaminase catalyzes the hydrolytic deamination of adenine or adenosine in deoxyribonucleic acid (DNA). The adenosine deaminases (e.g. engineered adenosine deaminases, evolved adenosine deaminases) provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, E. coli, S. aureus, S. typhi, S. putrefaciens, H. influenzae, or C. crescentus. In some embodiments, the adenosine deaminase is a TadA deaminase. In some embodiments, the TadA deaminase is an E. coli TadA deaminase (ecTadA). In some embodiments, the TadA deaminase is a truncated E. coli TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine In some embodiments, the TadA deaminase is an N-terminal truncated TadA. In certain embodiments, the adenosine deaminase comprises the amino acid sequence:

(SEQ ID NO: 1)
MSEVEFSHEYWMRHALTLAKRAWDEREVPVGAVLVHNNRVIGEGWNRPIG

RHDPTAHAEIMALRQGGLVMQNYRLIDATLYVTLEPCVMCAGAMIHSRIG

-continued

RVVFGARDAKTGAAGSLMDVLHHPGMNHRVEITEGILADECAALLSDFFR

MRRQEIKAQKKAQSSTD.

In some embodiments the TadA deaminase is a full-length *E. coli* TadA deaminase. For example, in certain embodiments, the adenosine deaminase comprises the amino acid sequence:

(SEQ ID NO: 84)
MRRAFITGVFFLSEVEFSHEYWMRHALTLAKRAWDEREVPVGAVLVHNNR

VIGEGWNRPIGRHDPTAHAEIMALRQGGLVMQNYRLIDATLYVTLEPCVM

CAGAMIHSRIGRVVFGARDAKTGAAGSLMDVLHHPGMNHRVEITEGILAD

ECAALLSDFFRMRRQEIKAQKKAQSSTD

It should be appreciated, however, that additional adenosine deaminases useful in the present application would be apparent to the skilled artisan and are within the scope of this disclosure. For example, the adenosine deaminase may be a homolog of an ADAT. Exemplary ADAT homologs include, without limitation:

*Staphylococcus aureus* TadA:
(SEQ ID NO: 8)
MGSHMTNDIYFMTLAIEEAKKAAQLGEVPIGAIITKDDEVIARAHNLRET

LQQPTAHAEHIAIERAAKVLGSWRLEGCTLYVTLEPCVMCAGTIVMSRIP

RVVYGADDPKGGCSGSLMNLLQQSNFNHRAIVDKGVLKEACSTLLTTFFK

NLRANKKSTN

*Bacillus subtilis* TadA:
(SEQ ID NO: 9)
MTQDELYMKEAIKEAKKAEEKGEVPIGAVLVINGEIIARAHNLRETEQRS

IAHAEMLVIDEACKALGTWRLEGATLYVTLEPCPMCAGAVVLSRVEKVVF

GAFDPKGGCSGTLMNLLQEERFNHQAEVVSGVLEEECGGMLSAFFRELRK

KKKAARKNLSE

*Salmonella typhimurium* (*S. typhimurium*) TadA:
(SEQ ID NO: 371)
MPPAFITGVTSLSDVELDHEYWMRHALTLAKRAWDEREVPVGAVLVHNHR

VIGEGWNRPIGRHDPTAHAEIMALRQGGLVLQNYRLLDTTLYVTLEPCVM

CAGAMVHSRIGRVVFGARDAKTGAAGSLIDVLHHPGMNHRVEIIEGVLRD

ECATLLSDFFRMRRQEIKALKKADRAEGAPAV

*Shewanella putrefaciens* (*S. putrefaciens*) TadA:
(SEQ ID NO: 372)
MDEYWMQVAMQMAEKAEAAGEVPVGAVLVKDGQQIATGYNLSISQHDPTA

HAEILCLRSAGKKLENYRLLDATLYITLEPCAMCAGAMVHSRIARVVYGA

RDEKTGAAGTVVNLLQHPAFNHQVEVTSGVLAEACSAQLSRFFKRRRDEK

KALKLAQRAQQGIE

*Haemophilus influenzae* F3031 (*H. influenzae*) TadA:
(SEQ ID NO: 373)
VMDAAKVRSEFDEKMMRYALELADKAEALGEIPVGAVLVDDARNIIGEGWN

LSIVQSDPTAHAEIIALRNGAKNIQNYRLLNSTLYVTLEPCTMCAGAILH

SRIKRLVFGASDYKTGAIGSRFHFFDDYKMNHTLEITSGVLAEECSQKLS

TFFQKRREEKKIEKALLKSLSDK

*Caulobacter crescentus* (*C. crescentus*) TadA:
(SEQ ID NO: 374)
MRTDESEDQDHRMMRLALDAARAAAEAGETPVGAVILDPSTGEVIATAGN

GPIAAHDPTAHAEIAAMRAAAAKLGNYRLTDLTLVVTLEPCAMCAGAISH

ARIGRVVFGADDPKGGAVVHGPKFFAQPTCHWRPEVTGGVLADESADLLR

GFFRARRKAKI

*Geobacter sulfurreducens* (*G. sulfurreducens*) TadA:
(SEQ ID NO: 375)
MSSLKKTPIRDDAYWMGKAIREAAKAAARDEVPIGAVIVRDGAVIGRGHN

LREGSNDPSAHAEMIAIRQAARRSANWRLTGATLYVTLEPCLMCMGAIIL

ARLERVVFGCYDPKGGAAGSLYDLSADPRLNHQVRLSPGVCQEECGTMLS

DFFRDLRRRKKAKATPALFIDERKVPPEP

The term "base editor (BE)," or "nucleobase editor (NBE)" refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid. In some embodiments, the base editor is capable of deaminating a base within a DNA molecule. In some embodiments, the base editor is capable of deaminating an adenine (A) in DNA. In some embodiments, the base editor is a fusion protein comprising a nucleic acid programmable DNA binding protein (napDNAbp) fused to an adenosine deaminase. In some embodiments, the base editor is a Cas9 protein fused to an adenosine deaminase. In some embodiments, the base editor is a Cas9 nickase (nCas9) fused to an adenosine deaminase. In some embodiments, the base editor is a nuclease-inactive Cas9 (dCas9) fused to an adenosine deaminase. In some embodiments, the base editor is fused to an inhibitor of base excision repair, for example, a UGI domain, or a dISN domain. In some embodiments, the fusion protein comprises a Cas9 nickase fused to a deaminase and an inhibitor of base excision repair, such as a UGI or dISN domain. In some embodiments, the dCas9 domain of the fusion protein comprises a D10A and a H840A mutation of SEQ ID NO: 52, or a corresponding mutation in any of SEQ ID NOs: 108-357, which inactivates the nuclease activity of the Cas9 protein. In some embodiments, the fusion protein comprises a D10A mutation and comprises a histidine at residue 840 of SEQ ID NO: 52, or a corresponding mutation in any of SEQ ID NOs: 108-357, which renders Cas9 capable of cleaving only one strand of a nucleic acid duplex. An example of a Cas9 nickase is shown in SEQ ID NO: 35.

The term "linker," as used herein, refers to a bond (e.g., covalent bond), chemical group, or a molecule linking two molecules or moieties, e.g., two domains of a fusion protein, such as, for example, a nuclease-inactive Cas9 domain and a nucleic acid-editing domain (e.g., an adenosine deaminase). In some embodiments, a linker joins a gRNA binding domain of an RNA-programmable nuclease, including a Cas9 nuclease domain, and the catalytic domain of a nucleic-acid editing protein. In some embodiments, a linker joins a dCas9 and a nucleic-acid editing protein. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises (SGGS)$_n$ (SEQ ID NO: 37), (GGGS)$_n$ (SEQ ID NO: 38), (GGGGS)$_n$ (SEQ ID NO: 39), (G)$_n$, (EAAAK)$_n$ (SEQ ID NO: 40), (GGS)$_n$, SGSETPGTSESATPES (SEQ ID NO: 10), or (XP)$_n$ motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15.

The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* (4$^{th}$ ed., Cold Spring Harbor Laboratory Press, Cold Spring Harbor, N.Y. (2012)).

The term "inhibitor of base repair" or "IBR" refers to a protein that is capable in inhibiting the activity of a nucleic acid repair enzyme, for example a base excision repair enzyme. In some embodiments, the IBR is an inhibitor of inosine base excision repair. Exemplary inhibitors of base repair include inhibitors of APE 1, Endo III, Endo IV, Endo V, Endo VIII, Fpg, hOGG1, hNEIL1, T7 EndoI, T4PDG, UDG, hSMUG1, and hAAG. In some embodiments, the IBR is an inhibitor of Endo V or hAAG. In some embodiments, the IBR is a catalytically inactive EndoV or a catalytically inactive hAAG.

The term "uracil glycosylase inhibitor" or "UGI," as used herein, refers to a protein that is capable of inhibiting a uracil-DNA glycosylase base-excision repair enzyme. In some embodiments, a UGI domain comprises a wild-type UGI or a UGI as set forth in SEQ ID NO: 3. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3. In some embodiments, a UGI comprises an amino acid sequence homologous to the amino acid sequence set forth in SEQ ID NO: 3, or an amino acid sequence homologous to a fragment of the amino acid sequence set forth in SEQ ID NO: 3. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3. In some embodiments, the UGI comprises the following amino acid sequence: >sp|P14739|UNGI_BPPB2 Uracil-DNA glycosylase inhibitor MTNLSDIIEKETGKQLVIQE-SILMLPEEVEEVIGNKPESDILVHTAYDEST-DENVMLLT SDAPEYKPWALVIQDSNGENKIKML (SEQ ID NO: 3).

The term "catalytically inactive inosine-specific nuclease," or "dead inosine-specific nuclease (dISN)," as used herein, refers to a protein that is capable of inhibiting an inosine-specific nuclease. Without wishing to be bound by any particular theory, catalytically inactive inosine glycosylases (e.g., alkyl adenine glycosylase [AAG]) will bind inosine, but will not create an abasic site or remove the inosine, thereby sterically blocking the newly-formed inosine moiety from DNA damage/repair mechanisms. In some embodiments, the catalytically inactive inosine-specific nuclease may be capable of binding an inosine in a nucleic acid but does not cleave the nucleic acid. Exemplary catalytically inactive inosine-specific nucleases include, without limitation, catalytically inactive alkyl adenosine glycosylase (AAG nuclease), for example, from a human, and catalytically inactive endonuclease V (EndoV nuclease), for example, from *E. coli*. In some embodiments, the catalytically inactive AAG nuclease comprises an E125Q mutation as shown in SEQ ID NO: 32, or a corresponding mutation in another AAG nuclease. In some embodiments, the catalytically inactive AAG nuclease comprises the amino acid sequence set forth in SEQ ID NO: 32. In some embodiments, the catalytically inactive EndoV nuclease comprises an D35A mutation as shown in SEQ ID NO 32, or a corresponding mutation in another EndoV nuclease. In some embodiments, the catalytically inactive EndoV nuclease comprises the amino acid sequence set forth in SEQ ID NO: 33. It should be appreciated that other catalytically inactive inosine-specific nucleases (dISNs) would be apparent to the skilled artisan and are within the scope of this disclosure. Truncated AAG (*H. sapiens*) nuclease (E125Q); mutated residue underlined in bold.

KGHLTRLGLEFFDQPAV-PLARAFLGQVLVRRLPNGTELRGRIVETQAY LGPEDEAAHSRGGRQTPRNRGMFMKPGTLY-VYIIYGMYFCMNISSQGDGACVLLRA LEPLE-GLETMRQLRSTLRKGTASRVLKDRELCSGPSKLCQ-ALAINKSFDQRDLAQDE AVWLERGPLEPSEPAVVAAARVGVGHAGEW-ARKPLRFYVRGSPWVSVVDRVAEQ DTQA (SEQ ID NO: 32)
EndoV nuclease (D35A); mutated residue underlined in bold.

```
                                        (SEQ ID NO: 33)
DLASLRAQQIELASSVIREDRLDKDPPDLIAGAAVGFEQGGEVTRAAMVL

LKYPSLELVEYKVARIATTMPYIPGFLSFREYPALLAAWEMLSQKPDLVF

VDGHGISHPRRLGVASHFGLLVDVPTIGVAKKRLCGKFEPLSSEPGALAP
```

-continued

LMDKGEQLAWVWRSKARCNPLFIATGHRVSVDSALAWVQRCMKGYRLPEP

TRWADAVASERPAFVRYTANQP

The term "nuclear localization sequence" or "NLS" refers to an amino acid sequence that promotes import of a protein into the cell nucleus, for example, by nuclear transport. Nuclear localization sequences are known in the art and would be apparent to the skilled artisan. For example, NLS sequences are described in Plank et al., international PCT application, PCT/EP2000/011690, filed Nov. 23, 2000, published as WO/2001/038547 on May 31, 2001, the contents of which are incorporated herein by reference for their disclosure of exemplary nuclear localization sequences. In some embodiments, a NLS comprises the amino acid sequence PKKKRKV (SEQ ID NO: 4) or MDSLLMNRRKFLYQFKNVRWAKGRRETYLC (SEQ ID NO: 5).

The term "nucleic acid programmable DNA binding protein" or "napDNAbp" refers to a protein that associates with a nucleic acid (e.g., DNA or RNA), such as a guide nucleic acid, that guides the napDNAbp to a specific nucleic acid sequence. For example, a Cas9 protein can associate with a guide RNA that guides the Cas9 protein to a specific DNA sequence that has complementary to the guide RNA. In some embodiments, the napDNAbp is a class 2 microbial CRISPR-Cas effector. In some embodiments, the napDNAbp is a Cas9 domain, for example a nuclease active Cas9, a Cas9 nickase (nCas9), or a nuclease inactive Cas9 (dCas9). Examples of nucleic acid programmable DNA binding proteins include, without limitation, Cas9 (e.g., dCas9 and nCas9), CasX, CasY, Cpf1, C2c1, C2c2, C2C3, and Argonaute. It should be appreciated, however, that nucleic acid programmable DNA binding proteins also include nucleic acid programmable proteins that bind RNA. For example, the napDNAbp may be associated with a nucleic acid that guides the napDNAbp to an RNA. Other nucleic acid programmable DNA binding proteins are also within the scope of this disclosure, though they may not be specifically listed in this disclosure.

The term "Cas9" or "Cas9 domain" refers to an RNA-guided nuclease comprising a Cas9 protein, or a fragment thereof (e.g., a protein comprising an active, inactive, or partially active DNA cleavage domain of Cas9, and/or the gRNA binding domain of Cas9). A Cas9 nuclease is also referred to sometimes as a casn1 nuclease or a CRISPR (clustered regularly interspaced short palindromic repeat)-associated nuclease. CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (mc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek M., Chylinski K., Fonfara I., Hauer M., Doudna J. A., Charpentier E. *Science* 337:816-821(2012), the entire contents of which is hereby incorporated by reference. Cas9 recognizes a short motif in the CRISPR repeat sequences (the PAM or protospacer adjacent motif) to help distinguish self versus non-self. Cas9 nuclease sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. *Science* 337:816-821(2012), the entire contents of each of which are incorporated herein by reference). Cas9 orthologs have been described in various species, including, but not limited to, *S. pyogenes* and *S. thermophilus*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase.

A nuclease-inactivated Cas9 protein may interchangeably be referred to as a "dCas9" protein (for nuclease-"dead" Cas9). Methods for generating a Cas9 protein (or a fragment thereof) having an inactive DNA cleavage domain are known (See, e.g., Jinek et al., *Science*. 337:816-821(2012); Qi et al., "Repurposing CRISPR as an RNA-Guided Platform for Sequence-Specific Control of Gene Expression" (2013) *Cell*. 28; 152(5):1173-83, the entire contents of each of which are incorporated herein by reference). For example, the DNA cleavage domain of Cas9 is known to include two subdomains, the HNH nuclease subdomain and the RuvC1 subdomain. The HNH subdomain cleaves the strand complementary to the gRNA, whereas the RuvC1 subdomain cleaves the non-complementary strand. Mutations within these subdomains can silence the nuclease activity of Cas9. For example, the mutations D10A and H840A completely inactivate the nuclease activity of *S. pyogenes* Cas9 (Jinek et al., *Science*. 337:816-821(2012); Qi et al., *Cell*. 28; 152(5):1173-83 (2013)). In some embodiments, proteins comprising fragments of Cas9 are provided. For example, in some embodiments, a protein comprises one of two Cas9 domains: (1) the gRNA binding domain of Cas9; or (2) the DNA cleavage domain of Cas9. In some embodiments, proteins comprising Cas9 or fragments thereof are referred to as "Cas9 variants." A Cas9 variant shares homology to Cas9, or a fragment thereof. For example a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

In some embodiments, the fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or 1300 amino acids in length. In some embodiments, wild type Cas9 corresponds to Cas9 from *Streptococcus pyogenes* (NCBI Reference Sequence: NC_017053.1, SEQ ID NO: 47 (nucleotide); SEQ ID NO: 48 (amino acid)).

(SEQ ID NO: 47)
```
ATGGATAAGAAATACTCAATAGGCTTAGATATCGGCACAAATAGCGTCGGATGG
GCGGTGATCACTGATGATTATAAGGTTCCGTCTAAAAAGTTCAAGGTTCTGGGAA
ATACAGACCGCCACAGTATCAAAAAAAATCTTATAGGGGCTCTTTTATTTGGCAG
TGGAGAGACAGCGGAAGCGACTCGTCTCAAACGGACAGCTCGTAGAAGGTATAC
ACGTCGGAAGAATCGTATTTGTTATCTACAGGAGATTTTTTCAAATGAGATGGCG
AAAGTAGATGATAGTTTCTTTCATCGACTTGAAGAGTCTTTTTTGGTGGAAGAAG
ACAAGAAGCATGAACGTCATCCTATTTTTGGAAATATAGTAGATGAAGTTGCTTA
TCATGAGAAATATCCAACTATCTATCATCTGCGAAAAAATTGGCAGATTCTACT
GATAAAGCGGATTTGCGCTTAATCTATTTGGCCTTAGCGCATATGATTAAGTTTC
GTGGTCATTTTTTGATTGAGGGAGATTTAAATCCTGATAATAGTGATGTGGACAA
ACTATTTATCCAGTTGGTACAAATCTACAATCAATTATTTGAAGAAAACCCTATT
AACGCAAGTAGAGTAGATGCTAAAGCGATTCTTTCTGCACGATTGAGTAAATCA
AGACGATTAGAAAATCTCATTGCTCAGCTCCCCGGTGAGAAGAGAAATGGCTTG
TTTGGGAATCTCATTGCTTTGTCATTGGGATTGACCCCTAATTTTAAATCAAATTT
TGATTTGGCAGAAGATGCTAAATTACAGCTTTCAAAAGATACTTACGATGATGAT
TTAGATAATTTATTGGCGCAAATTGGAGATCAATATGCTGATTTGTTTTTGGCAG
CTAAGAATTTATCAGATGCTATTTTACTTTCAGATATCCTAAGAGTAAATAGTGA
AATAACTAAGGCTCCCCTATCAGCTTCAATGATTAAGCGCTACGATGAACATCAT
CAAGACTTGACTCTTTTAAAAGCTTTAGTTCGACAACAACTTCCAGAAAAGTATA
AAGAAATCTTTTTTGATCAATCAAAAAACGGATATGCAGGTTATATTGATGGGGG
AGCTAGCCAAGAAGAATTTTATAAATTTATCAAACCAATTTTAGAAAAAATGGAT
GGTACTGAGGAATTATTGGTGAAACTAAATCGTGAAGATTTGCTGCGCAAGCAA
CGGACCTTTGACAACGGCTCTATTCCCCATCAAATTCACTTGGGTGAGCTGCATG
CTATTTTGAGAAGACAAGAAGACTTTTATCCATTTTTAAAAGACAATCGTGAGAA
GATTGAAAAAATCTTGACTTTTCGAATTCCTTATTATGTTGGTCCATTGGCGCGTG
GCAATAGTCGTTTTGCATGGATGACTCGGAAGTCTGAAGAAACAATTACCCCATG
GAATTTTGAAGAAGTTGTCGATAAAGGTGCTTCAGCTCAATCATTTATTGAACGC
ATGACAAACTTTGATAAAAATCTTCCAAATGAAAAAGTACTACCAAAACATAGT
TTGCTTTATGAGTATTTTACGGTTTATAACGAATTGACAAAGGTCAAATATGTTA
CTGAGGGAATGCGAAAACCAGCATTTCTTTCAGGTGAACAGAAGAAAGCCATTG
TTGATTTACTCTTCAAAACAAATCGAAAAGTAACCGTTAAGCAATTAAAAGAAG
```

-continued

```
ATTATTTCAAAAAAATAGAATGTTTTGATAGTGTTGAAATTTCAGGAGTTGAAGA

TAGATTTAATGCTTCATTAGGCGCCTACCATGATTTGCTAAAAATTATTAAAGAT

AAAGATTTTTTGGATAATGAAGAAAATGAAGATATCTTAGAGGATATTGTTTTAA

CATTGACCTTATTTGAAGATAGGGGGATGATTGAGGAAAGACTTAAAACATATG

CTCACCTCTTTGATGATAAGGTGATGAAACAGCTTAAACGTCGCCGTTATACTGG

TTGGGGACGTTTGTCTCGAAAATTGATTAATGGTATTAGGGATAAGCAATCTGGC

AAAACAATATTAGATTTTTTGAAATCAGATGGTTTTGCCAATCGCAATTTTATGC

AGCTGATCCATGATGATAGTTTGACATTTAAAGAAGATATTCAAAAAGCACAGG

TGTCTGGACAAGGCCATAGTTTACATGAACAGATTGCTAACTTAGCTGGCAGTCC

TGCTATTAAAAAAGGTATTTTACAGACTGTAAAAATTGTTGATGAACTGGTCAAA

GTAATGGGCATAAGCCAGAAAATATCGTTATTGAAATGGCACGTGAAAATCAG

ACAACTCAAAAGGGCCAGAAAAATTCGCGAGAGCGTATGAAACGAATCGAAGA

AGGTATCAAAGAATTAGGAAGTCAGATTCTTAAAGAGCATCCTGTTGAAAATAC

TCAATTGCAAAATGAAAAGCTCTATCTCTATTATCTACAAAATGGAAGAGACATG

TATGTGGACCAAGAATTAGATATTAATCGTTTAAGTGATTATGATGTCGATCACA

TTGTTCCACAAAGTTTCATTAAAGACGATTCAATAGACAATAAGGTACTAACGCG

TTCTGATAAAAATCGTGGTAAATCGGATAACGTTCCAAGTGAAGAAGTAGTCAA

AAAGATGAAAAACTATTGGAGACAACTTCTAAACGCCAAGTTAATCACTCAACG

TAAGTTTGATAATTTAACGAAAGCTGAACGTGGAGGTTTGAGTGAACTTGATAAA

GCTGGTTTTATCAAACGCCAATTGGTTGAAACTCGCCAAATCACTAAGCATGTGG

CACAAATTTTGGATAGTCGCATGAATACTAAATACGATGAAAATGATAAACTTAT

TCGAGAGGTTAAAGTGATTACCTTAAAATCTAAATTAGTTTCTGACTTCCGAAAA

GATTTCCAATTCTATAAAGTACGTGAGATTAACAATTACCATCATGCCCATGATG

CGTATCTAAATGCCGTCGTTGGAACTGCTTTGATTAAGAAATATCCAAAACTTGA

ATCGGAGTTTGTCTATGGTGATTATAAAGTTTATGATGTTCGTAAAATGATTGCT

AAGTCTGAGCAAGAAATAGGCAAAGCAACCGCAAAATATTTCTTTTACTCTAATA

TCATGAACTTCTTCAAAACAGAAATTACACTTGCAAATGGAGAGATTCGCAAAC

GCCCTCTAATCGAAACTAATGGGGAAACTGGAGAAATTGTCTGGGATAAAGGGC

GAGATTTTGCCACAGTGCGCAAAGTATTGTCCATGCCCCAAGTCAATATTGTCAA

GAAAACAGAAGTACAGACAGGCGGATTCTCCAAGGAGTCAATTTTACCAAAAAG

AAATTCGGACAAGCTTATTGCTCGTAAAAAAGACTGGGATCCAAAAAAATATGG

TGGTTTTGATAGTCCAACGGTAGCTTATTCAGTCCTAGTGGTTGCTAAGGTGGAA

AAAGGGAAATCGAAGAAGTTAAAATCCGTTAAAGAGTTACTAGGGATCACAATT

ATGGAAAGAAGTTCCTTTGAAAAAAATCCGATTGACTTTTTAGAAGCTAAAGGAT

ATAAGGAAGTTAAAAAAGACTTAATCATTAAACTACCTAAATATAGTCTTTTTGA

GTTAGAAAACGGTCGTAAACGGATGCTGGCTAGTGCCGGAGAATTACAAAAAGG

AAATGAGCTGGCTCTGCCAAGCAAATATGTGAATTTTTTATATTTAGCTAGTCAT

TATGAAAAGTTGAAGGGTAGTCCAGAAGATAACGAACAAAAACAATTGTTTGTG

GAGCAGCATAAGCATTATTTAGATGAGATTATTGAGCAAATCAGTGAATTTTCTA

AGCGTGTTATTTTAGCAGATGCCAATTTAGATAAAGTTCTTAGTGCATATAACAA

ACATAGAGACAAACCAATACGTGAACAAGCAGAAAATATTATTCATTTATTTAC
```

```
GTTGACGAATCTTGGAGCTCCCGCTGCTTTTAAATATTTTGATACAACAATTGATC

GTAAACGATATACGTCTACAAAAGAAGTTTTAGATGCCACTCTTATCCATCAATC

CATCACTGGTCTTTATGAAACACGCATTGATTTGAGTCAGCTAGGAGGTGACTGA
```

(SEQ ID NO:48)

```
MDKKYSIGLDIGTNSVGWAVITDDYKVPSKKFKVLGNTDRHSIKKNLIGALLFGSGE

TAEATRLKRTARRRYTRRKNRICYLQEIFSNEMAKVDDSFFHRLEESFLVEEDKKHE

RHPIFGNIVDEVAYHEKYPTIYHLRKKLADSTDKADLRLIYLALAHMIKFRGHFLIEG

DLNPDNSDVDKLFIQLVQIYNQLFEENPINASRVDAKAILSARLSKSRRLENLIAQLPG

EKRNGLFGNLIALSLGLTPNFKSNFDLAEDAKLQLSKDTYDDDLDNLLAQIGDQYAD

LFLAAKNLSDAILLSDILRVNSEITKAPLSASMIKRYDEHHQDLTLLKALVRQQLPEK

YKEIFFDQSKNGYAGYIDGGASQEEFYKFIKPILEKMDGTEELLVKLNREDLLRKQRT

FDNGSIPHQIHLGELHAILRRQEDFYPFLKDNREKIEKILTFRIPYYVGPLARGNSRFA

WMTRKSEETITPWNFEEVVDKGASAQSFIERMTNFDKNLPNEKVLPKHSLLYEYFTV

YNELTKVKYVTEGMRKPAFLSGEQKKAIVDLLFKTNRKVTVKQLKEDYFKKIECFD

SVEISGVEDRFNASLGAYHDLLKIIKDKDFLDNEENEDILEDIVLTLTLFEDRGMIEER

LKTYAHLFDDKVMKQLKRRRYTGWGRLSRKLINGIRDKQSGKTILDFLKSDGFANR

NFMQLIHDDSLTFKEDIQKAQVSGQGHSLHEQIANLAGSPAIKKGILQTVKIVDELVK

VMGHKPENIVIEMARENQTTQKGQKNSRERMKRIEEGIKELGSQILKEHPVENTQLQ

NEKLYLYYLQNGRDMYVDQELDINRLSDYDVDHIVPQSFIKDDSIDNKVLTRSDKNR

GKSDNVPSEEVVKKMKNYWRQLLNAKLITQRKFDNLTKAERGGLSELDKAGFIKRQ

LVETRQITKHVAQILDSRMNTKYDENDKLIREVKVITLKSKLVSDERKDFQFYKVREI

NNYHHAHDAYLNAVVGTALIKKYPKLESEFVYGDYKVYDVRKMIAKSEQEIGKAT

AKYFFYSNIMNFFKTEITLANGEIRKRPLIETNGETGEIVWDKGRDFATVRKVLSMPQ

VNIVKKTEVQTGGFSKESILPKRNSDKLIARKKDWDPKKYGGFDSPTVAYSVLVVAK

VEKGKSKKLKSVKELLGITIMERSSFEKNPIDFLEAKGYKEVKKDLIIKLPKYSLFELE

NGRKRMLASAGELQKGNELALPSKYVNFLYLASHYEKLKGSPEDNEQKQLFVEQHK

HYLDEIIEQISEFSKRVILADANLDKVLSAYNKHRDKPIREQAENIIHLFTLTNLGAPA

AFKYFDTTIDRKRYTSTKEVLDATLIHQSITGLYETRIDLSQLGGD
```

(single underline: HNH domain; double underline: RuvC domain)

In some embodiments, wild type Cas9 corresponds to, or comprises SEQ ID NO:49 (nucleotide) and/or SEQ ID NO: 50 (amino acid):

(SEQ ID NO: 49)
```
ATGGATAAAAAGTATTCTATTGGTTTAGACATCGGCACTAATTCCGTTGGATGGG

CTGTCATAACCGATGAATACAAAGTACCTTCAAAGAAATTTAAGGTGTTGGGGA

ACACAGACCGTCATTCGATTAAAAAGAATCTTATCGGTGCCCTCCTATTCGATAG

TGGCGAAACGGCAGAGGCGACTCGCCTGAAACGAACCGCTCGGAGAAGGTATAC

ACGTCGCAAGAACCGAATATGTTACTTACAAGAAATTTTTAGCAATGAGATGGCC

AAAGTTGACGATTCTTTCTTTCACCGTTTGGAAGAGTCCTTCCTTGTCGAAGAGG

ACAAGAAACATGAACGGCACCCCATCTTTGGAAACATAGTAGATGAGGTGGCAT

ATCATGAAAAGTACCCAACGATTTATCACCTCAGAAAAAAGCTAGTTGACTCAA
```

-continued

```
CTGATAAAGCGGACCTGAGGTTAATCTACTTGGCTCTTGCCCATATGATAAAGTT

CCGTGGGCACTTTCTCATTGAGGGTGATCTAAATCCGGACAACTCGGATGTCGAC

AAACTGTTCATCCAGTTAGTACAAACCTATAATCAGTTGTTTGAAGAGAACCCTA

TAAATGCAAGTGGCGTGGATGCGAAGGCTATTCTTAGCGCCCGCCTCTCTAAATC

CCGACGGCTAGAAAACCTGATCGCACAATTACCCGGAGAGAAGAAAAATGGGTT

GTTCGGTAACCTTATAGCGCTCTCACTAGGCCTGACACCAAATTTTAAGTCGAAC

TTCGACTTAGCTGAAGATGCCAAATTGCAGCTTAGTAAGGACACGTACGATGAC

GATCTCGACAATCTACTGGCACAAATTGGAGATCAGTATGCGGACTTATTTTTGG

CTGCCAAAAACCTTAGCGATGCAATCCTCCTATCTGACATACTGAGAGTTAATAC

TGAGATTACCAAGGCGCCGTTATCCGCTTCAATGATCAAAAGGTACGATGAACAT

CACCAAGACTTGACACTTCTCAAGGCCCTAGTCCGTCAGCAACTGCCTGAGAAAT

ATAAGGAAATATTCTTTGATCAGTCGAAAAACGGGTACGCAGGTTATATTGACG

GCGGAGCGAGTCAAGAGGAATTCTACAAGTTTATCAAACCCATATTAGAGAAGA

TGGATGGGACGGAAGAGTTGCTTGTAAAACTCAATCGCGAAGATCTACTGCGAA

AGCAGCGGACTTTCGACAACGGTAGCATTCCACATCAAATCCACTTAGGCGAATT

GCATGCTATACTTAGAAGGCAGGAGGATTTTTATCCGTTCCTCAAAGACAATCGT

GAAAAGATTGAGAAAATCCTAACCTTTCGCATACCTTACTATGTGGGACCCCTGG

CCCGAGGGAACTCTCGGTTCGCATGGATGACAAGAAAGTCCGAAGAAACGATTA

CTCCATGGAATTTTGAGGAAGTTGTCGATAAAGGTGCGTCAGCTCAATCGTTCAT

CGAGAGGATGACCAACTTTGACAAGAATTTACCGAACGAAAAAGTATTGCCTAA

GCACAGTTTACTTTACGAGTATTTCACAGTGTACAATGAACTCACGAAAGTTAAG

TATGTCACTGAGGGCATGCGTAAACCCGCCTTTCTAAGCGGAGAACAGAAGAAA

GCAATAGTAGATCTGTTATTCAAGACCAACCGCAAAGTGACAGTTAAGCAATTG

AAAGAGGACTACTTTAAGAAAATTGAATGCTTCGATTCTGTCGAGATCTCCGGGG

TAGAAGATCGATTTAATGCGTCACTTGGTACGTATCATGACCTCCTAAAGATAAT

TAAAGATAAGGACTTCCTGGATAACGAAGAGAATGAAGATATCTTAGAAGATAT

AGTGTTGACTCTTACCCTCTTTGAAGATCGGGAAATGATTGAGGAAAGACTAAAA

ACATACGCTCACCTGTTCGACGATAAGGTTATGAAACAGTTAAAGAGGCGTCGCT

ATACGGGCTGGGGACGATTGTCGCGGAAACTTATCAACGGGATAAGAGACAAGC

AAAGTGGTAAAACTATTCTCGATTTTCTAAAGAGCGACGGCTTCGCCAATAGGAA

CTTTATGCAGCTGATCCATGATGACTCTTTAACCTTCAAAGAGGATATACAAAAG

GCACAGGTTTCCGGACAAGGGGACTCATTGCACGAACATATTGCGAATCTTGCTG

GTTCGCCAGCCATCAAAAAGGGCATACTCCAGACAGTCAAAGTAGTGGATGAGC

TAGTTAAGGTCATGGGACGTCACAAACCGGAAAACATTGTAATCGAGATGGCAC

GCGAAAATCAAACGACTCAGAAGGGGCAAAAAAACAGTCGAGAGCGGATGAAG

AGAATAGAAGAGGGTATTAAAGAACTGGGCAGCCAGATCTTAAAGGAGCATCCT

GTGGAAAATACCCAATTGCAGAACGAGAAACTTTACCTCTATTACCTACAAAATG

GAAGGGACATGTATGTTGATCAGGAACTGGACATAAACCGTTTATCTGATTACGA

CGTCGATCACATTGTACCCCAATCCTTTTTGAAGGACGATTCAATCGACAATAAA

GTGCTTACACGCTCGGATAAGAACCGAGGGAAAAGTGACAATGTTCCAAGCGAG
```

-continued

```
GAAGTCGTAAAGAAAATGAAGAACTATTGGCGGCAGCTCCTAAATGCGAAACTG

ATAACGCAAAGAAAGTTCGATAACTTAACTAAAGCTGAGAGGGGTGGCTTGTCT

GAACTTGACAAGGCCGGATTTATTAAACGTCAGCTCGTGGAAACCCGCCAAATC

ACAAAGCATGTTGCACAGATACTAGATTCCCGAATGAATACGAAATACGACGAG

AACGATAAGCTGATTCGGGAAGTCAAAGTAATCACTTTAAAGTCAAAATTGGTG

TCGGACTTCAGAAAGGATTTTCAATTCTATAAAGTTAGGGAGATAAATAACTACC

ACCATGCGCACGACGCTTATCTTAATGCCGTCGTAGGGACCGCACTCATTAAGAA

ATACCCGAAGCTAGAAAGTGAGTTTGTGTATGGTGATTACAAAGTTTATGACGTC

CGTAAGATGATCGCGAAAAGCGAACAGGAGATAGGCAAGGCTACAGCCAAATA

CTTCTTTTATTCTAACATTATGAATTTCTTTAAGACGGAAATCACTCTGGCAAACG

GAGAGATACGCAAACGACCTTTAATTGAAACCAATGGGGAGACAGGTGAAATCG

TATGGGATAAGGGCCGGGACTTCGCGACGGTGAGAAAAGTTTTGTCCATGCCCC

AAGTCAACATAGTAAAGAAAACTGAGGTGCAGACCGGAGGGTTTTCAAGGAAT

CGATTCTTCCAAAAAGGAATAGTGATAAGCTCATCGCTCGTAAAAAGGACTGGG

ACCCGAAAAAGTACGGTGGCTTCGATAGCCCTACAGTTGCCTATTCTGTCCTAGT

AGTGGCAAAAGTTGAGAAGGGAAAATCCAAGAAACTGAAGTCAGTCAAAGAAT

TATTGGGGATAACGATTATGGAGCGCTCGTCTTTTGAAAAGAACCCCATCGACTT

CCTTGAGGCGAAAGGTTACAAGGAAGTAAAAAAGGATCTCATAATTAAACTACC

AAAGTATAGTCTGTTTGAGTTAGAAAATGGCCGAAAACGGATGTTGGCTAGCGC

CGGAGAGCTTCAAAAGGGGAACGAACTCGCACTACCGTCTAAATACGTGAATTT

CCTGTATTTAGCGTCCCATTACGAGAAGTTGAAAGGTTCACCTGAAGATAACGAA

CAGAAGCAACTTTTTGTTGAGCAGCACAAACATTATCTCGACGAAATCATAGAGC

AAATTTCGGAATTCAGTAAGAGAGTCATCCTAGCTGATGCCAATCTGGACAAAGT

ATTAAGCGCATACAACAAGCACAGGGATAAACCCATACGTGAGCAGGCGGAAA

ATATTATCCATTTGTTTACTCTTACCAACCTCGGCGCTCCAGCCGCATTCAAGTAT

TTTGACACAACGATAGATCGCAAACGATACACTTCTACCAAGGAGGTGCTAGAC

GCGACACTGATTCACCAATCCATCACGGGATTATATGAAACTCGGATAGATTTGT

CACAGCTTGGGGGTGACGGATCCCCCAAGAAGAAGAGGAAAGTCTCGAGCGACT

ACAAAGACCATGACGGTGATTATAAAGATCATGACATCGATTACAAGGATGACG

ATGACAAGGCTGCAGGA
```

(SEQ ID NO: 50)
MDKKYSIGLAIGTNSVGWAVITDEYKVPSKKFKVLGNTDRHSIKKNLIGALLEDSGE

TAEATRLKRTARRRYTRRKNRICYLQEIFSNEMAKVDDSFFHRLEESFLVEEDKKHE

RHPIFGNIVDEVAYHEKYPTIYHLRKKLVDSTDKADLRLIYLALAHMIKFRGHFLIEG

DLNPDNSDVDKLFIQLVQTYNQLFEENPINASGVDAKAILSARLSKSRRLENLIAQLP

GEKKNGLFGNLIALSLGLTPNFKSNFDLAEDAKLQLSKDTYDDDLDNLLAQIGDQYA

DLFLAAKNLSDAILLSDILRVNTEITKAPLSASMIKRYDEHHQDLTLLKALVRQQLPE

KYKEIFFDQSKNGYAGYIDGGASQEEFYKFIKPILEKMDGTEELLVKLNREDLLRKQR

TFDNGSIPHQIHLGELHAILRRQEDFYPFLKDNREKIEKILTFRIPYYVGPLARGNSRFA

WMTRKSEETITPWNFEEVVDKGASAQSFIERMTNFDKNLPNEKVLPKHSLLYEYFTV

YNELTKVKYVTEGMRKPAFLSGEQKKAIVDLLFKTNRKVTVKQLKEDYFKKIECFD

-continued

```
SVEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDERKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD
(single underline: HNH domain; double underline: RuvC domain)
```

In some embodiments, wild type Cas9 corresponds to Cas9 from *Streptococcus pyogenes* (NCBI Reference Sequence: NC_002737.2, SEQ ID NO: 51 (nucleotide); and Uniport Reference Sequence: Q99ZW2, SEQ ID NO: 52 (amino acid).

```
                                              (SEQ ID NO: 51)
ATGGATAAGAAATACTCAATAGGCTTAGATATCGGCACAAATAGCGTCGGATGG

GCGGTGATCACTGATGAATATAAGGTTCCGTCTAAAAAGTTCAAGGTTCTGGGAA

ATACAGACCGCCACAGTATCAAAAAAAATCTTATAGGGGCTCTTTTATTTGACAG

TGGAGAGACAGCGGAAGCGACTCGTCTCAAACGGACAGCTCGTAGAAGGTATAC

ACGTCGGAAGAATCGTATTTGTTATCTACAGGAGATTTTTTCAAATGAGATGGCG

AAAGTAGATGATAGTTTCTTTCATCGACTTGAAGAGTCTTTTTTGGTGGAAGAAG

ACAAGAAGCATGAACGTCATCCTATTTTTGGAAATATAGTAGATGAAGTTGCTTA

TCATGAGAAATATCCAACTATCTATCATCTGCGAAAAAAATTGGTAGATTCTACT

GATAAAGCGGATTTGCGCTTAATCTATTTGGCCTTAGCGCATATGATTAAGTTTC

GTGGTCATTTTTTGATTGAGGGAGATTTAAATCCTGATAATAGTGATGTGGACAA

ACTATTTATCCAGTTGGTACAAACCTACAATCAATTATTTGAAGAAAACCCTATT

AACGCAAGTGGAGTAGATGCTAAAGCGATTCTTTCTGCACGATTGAGTAAATCA

AGACGATTAGAAAATCTCATTGCTCAGCTCCCCGGTGAGAAGAAAAATGGCTTA

TTTGGGAATCTCATTGCTTTGTCATTGGGTTTGACCCCTAATTTTAAATCAAATTT

TGATTTGGCAGAAGATGCTAAATTACAGCTTTCAAAAGATACTTACGATGATGAT

TTAGATAATTTATTGGCGCAAATTGGAGATCAATATGCTGATTTGTTTTTGGCAG

CTAAGAATTTATCAGATGCTATTTTACTTTCAGATATCCTAAGAGTAAATACTGA

AATAACTAAGGCTCCCCTATCAGCTTCAATGATTAAACGCTACGATGAACATCAT

CAAGACTTGACTCTTTTAAAAGCTTTAGTTCGACAACAACTTCCAGAAAAGTATA

AAGAAATCTTTTTTGATCAATCAAAAAACGGATATGCAGGTTATATTGATGGGGG

AGCTAGCCAAGAAGAATTTTATAAATTTATCAAACCAATTTTAGAAAAAATGGAT
```

-continued

```
GGTACTGAGGAATTATTGGTGAAACTAAATCGTGAAGATTTGCTGCGCAAGCAA

CGGACCTTTGACAACGGCTCTATTCCCCATCAAATTCACTTGGGTGAGCTGCATG

CTATTTTGAGAAGACAAGAAGACTTTTATCCATTTTTAAAAGACAATCGTGAGAA

GATTGAAAAAATCTTGACTTTTCGAATTCCTTATTATGTTGGTCCATTGGCGCGTG

GCAATAGTCGTTTTGCATGGATGACTCGGAAGTCTGAAGAAACAATTACCCCATG

GAATTTTGAAGAAGTTGTCGATAAAGGTGCTTCAGCTCAATCATTTATTGAACGC

ATGACAAACTTTGATAAAAATCTTCCAAATGAAAAGTACTACCAAAACATAGT

TTGCTTTATGAGTATTTTACGGTTTATAACGAATTGACAAAGGTCAAATATGTTA

CTGAAGGAATGCGAAAACCAGCATTTCTTTCAGGTGAACAGAAGAAAGCCATTG

TTGATTTACTCTTCAAAACAAATCGAAAAGTAACCGTTAAGCAATTAAAAGAAG

ATTATTTCAAAAAAATAGAATGTTTTGATAGTGTTGAAATTTCAGGAGTTGAAGA

TAGATTTAATGCTTCATTAGGTACCTACCATGATTTGCTAAAAATTATTAAAGAT

AAAGATTTTTTGGATAATGAAGAAAATGAAGATATCTTAGAGGATATTGTTTTAA

CATTGACCTTATTTGAAGATAGGGAGATGATTGAGGAAAGACTTAAAACATATG

CTCACCTCTTTGATGATAAGGTGATGAAACAGCTTAAACGTCGCCGTTATACTGG

TTGGGGACGTTTGTCTCGAAAATTGATTAATGGTATTAGGGATAAGCAATCTGGC

AAAACAATATTAGATTTTTTGAAATCAGATGGTTTTGCCAATCGCAATTTTATGC

AGCTGATCCATGATGATAGTTTGACATTTAAAGAAGACATTCAAAAAGCACAAG

TGTCTGGACAAGGCGATAGTTTACATGAACATATTGCAAATTTAGCTGGTAGCCC

TGCTATTAAAAAAGGTATTTTACAGACTGTAAAAGTTGTTGATGAATTGGTCAAA

GTAATGGGGCGGCATAAGCCAGAAAATATCGTTATTGAAATGGCACGTGAAAAT

CAGACAACTCAAAAGGGCCAGAAAAATTCGCGAGAGCGTATGAAACGAATCGA

AGAAGGTATCAAAGAATTAGGAAGTCAGATTCTTAAAGAGCATCCTGTTGAAAA

TACTCAATTGCAAAATGAAAAGCTCTATCTCTATTATCTCCAAAATGGAAGAGAC

ATGTATGTGGACCAAGAATTAGATATTAATCGTTTAAGTGATTATGATGTCGATC

ACATTGTTCCACAAAGTTTCCTTAAAGACGATTCAATAGACAATAAGGTCTTAAC

GCGTTCTGATAAAAATCGTGGTAAATCGGATAACGTTCCAAGTGAAGAAGTAGT

CAAAAAGATGAAAAACTATTGGAGACAACTTCTAAACGCCAAGTTAATCACTCA

ACGTAAGTTTGATAATTTAACGAAAGCTGAACGTGGAGGTTTGAGTGAACTTGAT

AAAGCTGGTTTTATCAAACGCCAATTGGTTGAAACTCGCCAAATCACTAAGCATG

TGGCACAAATTTTGGATAGTCGCATGAATACTAAATACGATGAAAATGATAAAC

TTATTCGAGAGGTTAAAGTGATTACCTTAAAATCTAAATTAGTTTCTGACTTCCG

AAAAGATTTCCAATTCTATAAAGTACGTGAGATTAACAATTACCATCATGCCCAT

GATGCGTATCTAAATGCCGTCGTTGGAACTGCTTTGATTAAGAAATATCCAAAAC

TTGAATCGGAGTTTGTCTATGGTGATTATAAAGTTTATGATGTTCGTAAAATGATT

GCTAAGTCTGAGCAAGAAATAGGCAAAGCAACCGCAAAATATTTCTTTTACTCTA

ATATCATGAACTTCTTCAAAACAGAAATTACACTTGCAAATGGAGAGATTCGCAA

ACGCCCTCTAATCGAAACTAATGGGGAAACTGGAGAAATTGTCTGGGATAAAGG

GCGAGATTTTGCCACAGTGCGCAAAGTATTGTCCATGCCCCAAGTCAATATTGTC

AAGAAAACAGAAGTACAGACAGGCGGATTCTCCAAGGAGTCAATTTTACCAAAA

AGAAATTCGGACAAGCTTATTGCTCGTAAAAAAGACTGGGATCCAAAAAAATAT
```

-continued

```
GGTGGTTTTGATAGTCCAACGGTAGCTTATTCAGTCCTAGTGGTTGCTAAGGTGG

AAAAAGGGAAATCGAAGAAGTTAAAATCCGTTAAAGAGTTACTAGGGATCACAA

TTATGGAAAGAAGTTCCTTTGAAAAAAATCCGATTGACTTTTTAGAAGCTAAAGG

ATATAAGGAAGTTAAAAAAGACTTAATCATTAAACTACCTAAATATAGTCTTTTT

GAGTTAGAAAACGGTCGTAAACGGATGCTGGCTAGTGCCGGAGAATTACAAAAA

GGAAATGAGCTGGCTCTGCCAAGCAAATATGTGAATTTTTTATATTTAGCTAGTC

ATTATGAAAAGTTGAAGGGTAGTCCAGAAGATAACGAACAAAAACAATTGTTTG

TGGAGCAGCATAAGCATTATTTAGATGAGATTATTGAGCAAATCAGTGAATTTTC

TAAGCGTGTTATTTTAGCAGATGCCAATTTAGATAAAGTTCTTAGTGCATATAAC

AAACATAGAGACAAACCAATACGTGAACAAGCAGAAAATATTATTCATTTATTT

ACGTTGACGAATCTTGGAGCTCCCGCTGCTTTTAAATATTTTGATACAACAATTG

ATCGTAAACGATATACGTCTACAAAAGAAGTTTTAGATGCCACTCTTATCCATCA

ATCCATCACTGGTCTTTATGAAACACGCATTGATTTGAGTCAGCTAGGAGGTGAC

TGA
```

(SEQ ID NO: 52)
MDKK<u>YSIGLDIGTNSVGWAVITDEYKVPSKKFKVLGNTDRHSIKKNLIGALLEDSGE</u>
<u>T</u>AEATRLKRTARRRYTRRKNRICYLQEIFSNEMAKVDDSFFHRLEESFLVEEDKKHE
RHPIFGNIVDEVAYHEKYPTIYHLRKKLVDSTDKADLRLIYLALAHMIKFRGHFLIEG
DLNPDNSDVDKLFIQLVQTYNQLFEENPINASGVDAKAILSARLSKSRRLENLIAQLP
GEKKNGLFGNLIALSLGLTPNFKSNFDLAEDAKLQLSKDTYDDDLDNLLAQIGDQYA
DLFLAAKNLSDAILLSDILRVNTEITKAPLSASMIKRYDEHHQDLTLLKALVRQQLPE
KYKEIFFDQSKNGYAGYIDGGASQEEFYKFIKPILEKMDGTEELLVKLNREDLLRKQR
TFDNGSIPHQIHLGELHAILRRQEDFYPFLKDNREKIEKILTFRIPYYVGPLARGNSRFA
WMTRKSEETITPWNFEEVVDKGASAQSFIERMTNFDKNLPNEKVLPKHSLLYEYFTV
YNELTKVKYVTEGMRKPAFLSGEQKKAIVDLLFKTNRKVTVKQLKEDYFKKIECFD
SVEISGVEDRFNASLGTYHDLLKIIKDKDFLDNEENEDILEDIVLTLTLFEDREMIEERL
KTYAHLFDDKVMKQLKRRRYTGWGRLSRKLINGIRDKQSGKTILDFLKSDGFANRN
FMQLIHDDSLTFKEDIQKAQVSGQG<u><u>DSLHEHIANLAGSPAIKKGILQTVKVVDELVK</u></u>
<u><u>VMGRHKPENIVIEMARENQTTQKGQKNSRERMKRIEEGIKELGSQILKEHPVENTQL</u></u>
<u><u>QNEKLYLYYLQNGRDMYVDQELDINRLSDYDVDHIVPQSFLKDDSIDNKVLTRSDK</u></u>
<u><u>NRGKSDNVPSEEVVKKMKNYWRQLLNAKLITQRKEDNLTKAERG</u></u><u><u>GLSELDKAGFIK</u></u>
<u><u>RQLVETRQITKHVAQILDSRMNTKYDENDKLIREVKVITLKSKLVSDFRKDFQFYKV</u></u>
<u><u>REINNYHHAHDAYLNAVVGTALIKKYPKLESEFVYGDYKVYDVRKMIAKSEQEIGK</u></u>
<u><u>ATAKYFFYSNIMNFFKTEITLANGEIRKRPLIETNGETGEIVWDKGRDFATVRKVLSM</u></u>
<u><u>PQVNIVKKTEVQT</u></u>GGFSKESILPKRNSDKLIARKKDWDPKKYGGFDSPTVAYSVLVV
AKVEKGKSKKLKSVKELLGITIMERSSFEKNPIDFLEAKGYKEVKKDLIIKLPKYSLFE
LENGRKRMLASAGELQKGNELALPSKYVNFLYLASHYEKLKGSPEDNEQKQLFVEQ
HKHYLDEIIEQISEFSKRVILADANLDKVLSAYNKHRDKPIREQAENIIHLFTLTNLGA
PAAFKYFDTTIDRKRYTSTKEVLDATLIHQSITGLYETRIDLSQLGGD
(single underline: HNH domain; double underline: RuvC domain)

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); *Spiroplasma taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1), *Listeria innocua* (NCBI Ref: NP_472073.1), *Campylobacter jejuni* (NCBI Ref: YP_002344900.1) or *Neisseria. meningitidis* (NCBI Ref: YP_002342100.1) or to a Cas9 from any other organism.

In some embodiments, dCas9 corresponds to, or comprises in part or in whole, a Cas9 amino acid sequence having one or more mutations that inactivate the Cas9 nuclease activity. For example, in some embodiments, a dCas9 domain comprises D10A and an H840A mutation of SEQ ID NO: 52 or corresponding mutations in another Cas9. In some embodiments, the dCas9 comprises the amino acid sequence of SEQ ID NO: 53 dCas9 (D10A and H840A):

(SEQ ID NO: 53)
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQG<u>DSLHEHIANLAGSPAIKKGILQTVKVVDELVK

VMGRHKPENIVIEMARENQTTQKGQKNSRERMKRIEEGIKELGSQILKE

HPVENTQLQNEKLYLYYLQNGRDMYVDQELDINRLSDYDVDAIVPQSFL

KDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDE

NDKLIREVKVITLKSKLVSDFRKDFQFYKVREINNYHHAHDAYLNAVVG</u>

TALIKKYPKLESEFVYGDYKVYDVRKMIAKSEQEIGKATAKYFFYSNIM

NFFKTEITLANGEIRKRPLIETNGETGEIVWDKGRDFATVRKVLSMPQV

<u>NIVKKTE</u>VQTGGFSKESILPKRNSDKLIARKKDWDPKKYGGFDSPTVAY

SVLVVAKVEKGKSKKLKSVKELLGITIMERSSFEKNPIDFLEAKGYKEV

KKDLIIKLPKYSLFELENGRKRMLASAGELQKGNELALPSKYVNFLYLA

SHYEKLKGSPEDNEQKQLFVEQHKHYLDEIIEQISEFSKRVILADANLD

KVLSAYNKHRDKPIREQAENIIHLFTLTNLGAPAAFKYFDTTIDRKRYT

STKEVLDATLIHQSITGLYETRIDLSQLGGD
(single underline: HNH domain; double underline: RuvC domain).

Figure 94:
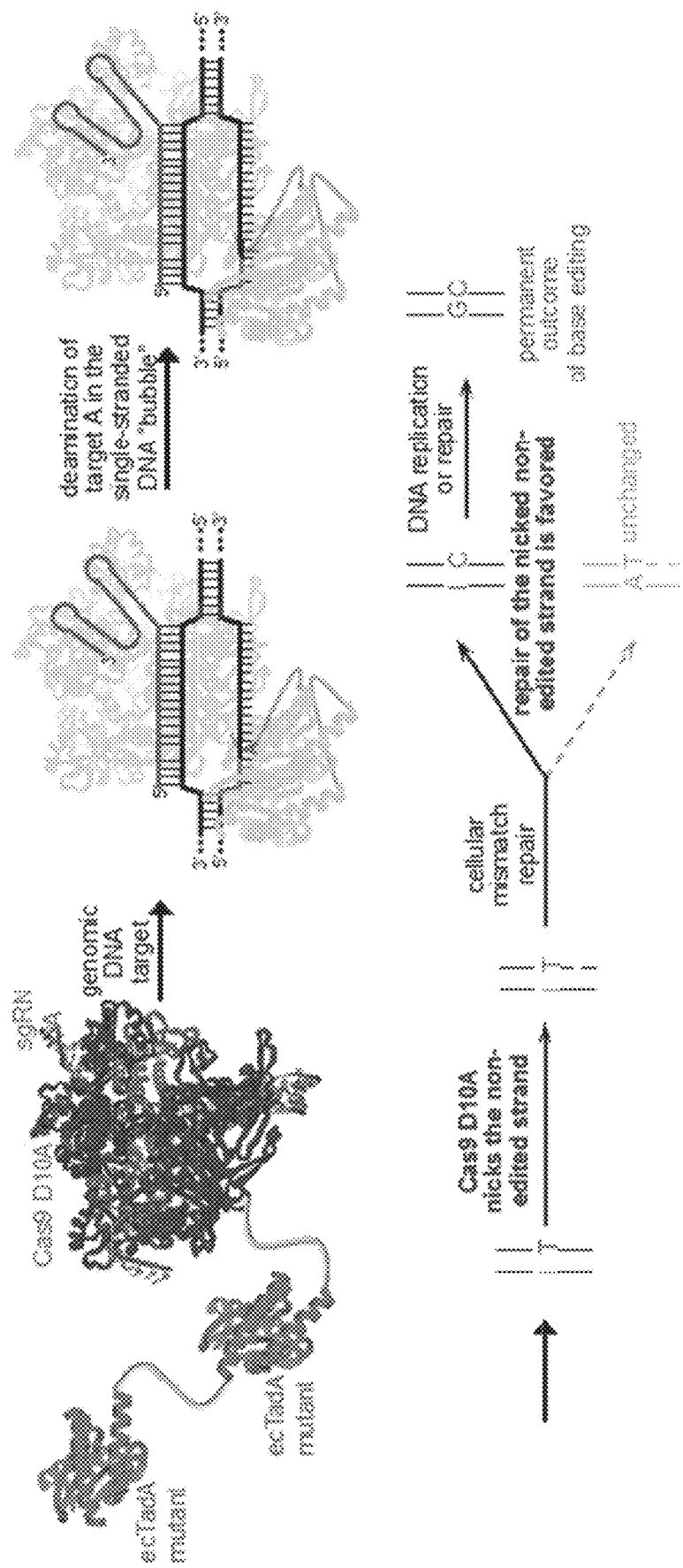
FIG. 94 shows a schematic representation of an exemplary adenosine base editing process.
Figure 95:
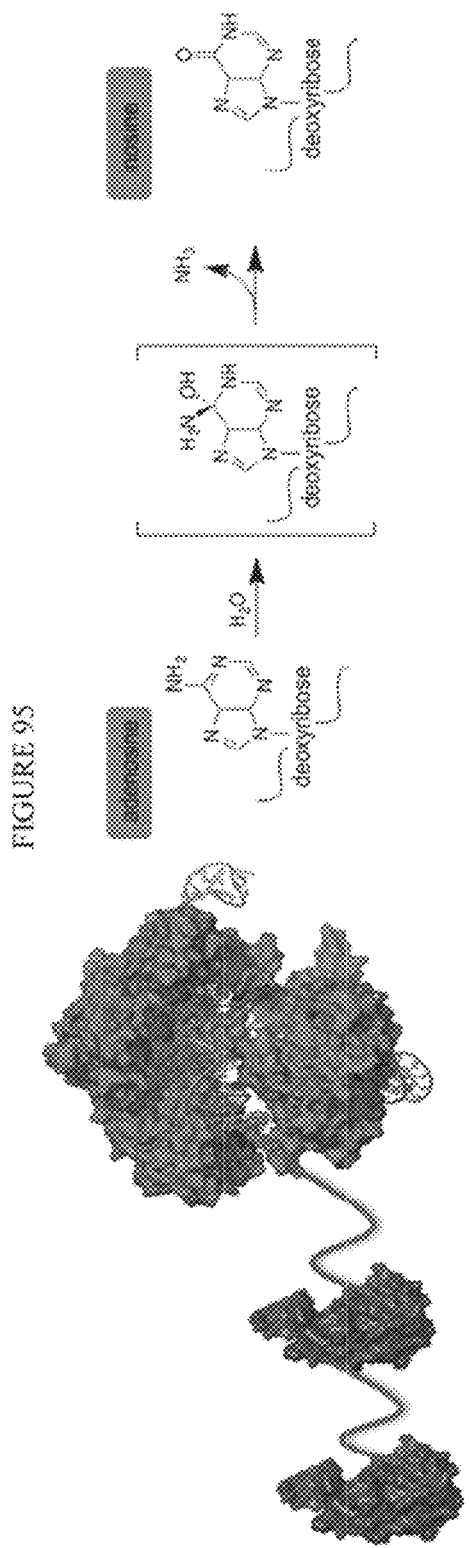
FIG. 95 shows a schematic representation of an exemplary adenosine base editor, which deaminates adenosine to inosine.

In some embodiments, the Cas9 domain comprises a D10A mutation, while the residue at position 840 remains a histidine in the amino acid sequence provided in SEQ ID NO: 52, or at corresponding positions in any of the amino acid sequences provided in SEQ ID NOs: 108-357. Without wishing to be bound by any particular theory, the presence of the catalytic residue H840 maintains the activity of the Cas9 to cleave the non-edited (e.g., non-deaminated) strand containing a T opposite the targeted A. Restoration of H840 (e.g., from A840 of a dCas9) does not result in the cleavage of the target strand containing the A. Such Cas9 variants are able to generate a single-strand DNA break (nick) at a specific location based on the gRNA-defined target sequence, leading to repair of the non-edited strand, ultimately resulting in a T to C change on the non-edited strand. A schematic representation of this process is shown in FIG. 94. Briefly, and without wishing to be bound by any particular theory, the A of a A-T base pair can be deaminated to a inosine (I) by an adenosine deaminase, e.g., an engineered adenosine deaminase that deaminates an adenosine in DNA. Nicking the non-edited strand, having the T, facilitates removal of the T via mismatch repair mechanisms. A UGI domain or a catalytically inactive inosine-specific nuclease (dISN) may inhibit inosine-specific nucleases (e.g., sterically) thereby preventing removal of the inosine (I).

In other embodiments, dCas9 variants having mutations other than D10A and H840A are provided, which, e.g., result in nuclease inactivated Cas9 (dCas9). Such mutations, by way of example, include other amino acid substitutions at D10 and H840, or other substitutions within the nuclease domains of Cas9 (e.g., substitutions in the HNH nuclease subdomain and/or the RuvC1 subdomain). In some embodiments, variants or homologues of dCas9 (e.g., variants of SEQ ID NO: 53) are provided which are at least about 70% identical, at least about 80% identical, at least about 90% identical, at least about 95% identical, at least about 98% identical, at least about 99% identical, at least about 99.5% identical, or at least about 99.9% identical to SEQ ID NO: 10. In some embodiments, variants of dCas9 (e.g., variants of SEQ ID NO: 53) are provided having amino acid sequences which are shorter, or longer than SEQ ID NO: 53, by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, Cas9 fusion proteins as provided herein comprise the full-length amino acid sequence of a Cas9 protein, e.g., one of the Cas9 sequences provided herein. In other embodiments, however, fusion proteins as provided herein do not comprise a full-length Cas9 sequence, but only a fragment thereof. For example, in some embodiments, a Cas9 fusion protein provided herein comprises a Cas9 fragment, wherein the fragment binds crRNA and tracrRNA or sgRNA, but does not comprise a functional nuclease domain, e.g., in that it comprises only a truncated version of a nuclease domain or no nuclease domain at all.

Exemplary amino acid sequences of suitable Cas9 domains and Cas9 fragments are provided herein, and additional suitable sequences of Cas9 domains and fragments will be apparent to those of skill in the art.

In some embodiments, Cas9 refers to Cas9 from: *Corynebacterium ulcerans* (NCBI Refs: NC_015683.1, NC_017317.1); *Corynebacterium diphtheria* (NCBI Refs: NC_016782.1, NC_016786.1); *Spiroplasma syrphidicola* (NCBI Ref: NC_021284.1); *Prevotella intermedia* (NCBI Ref: NC_017861.1); Spiroplasma *taiwanense* (NCBI Ref: NC_021846.1); *Streptococcus iniae* (NCBI Ref: NC_021314.1); *Belliella baltica* (NCBI Ref: NC_018010.1); *Psychroflexus torquisI* (NCBI Ref: NC_018721.1); *Streptococcus thermophilus* (NCBI Ref: YP_820832.1); *Listeria innocua* (NCBI Ref: NP_472073.1); *Campylobacter jejuni* (NCBI Ref: YP_002344900.1); or *Neisseria. meningitidis* (NCBI Ref: YP_002342100.1).

It should be appreciated that additional Cas9 proteins (e.g., a nuclease dead Cas9 (dCas9), a Cas9 nickase (nCas9), or a nuclease active Cas9), including variants and homologs thereof, are within the scope of this disclosure. Exemplary Cas9 proteins include, without limitation, those provided below. In some embodiments, the Cas9 protein is a nuclease dead Cas9 (dCas9). In some embodiments, the dCas9 comprises the amino acid sequence (SEQ ID NO: 34). In some embodiments, the Cas9 protein is a Cas9 nickase (nCas9). In some embodiments, the nCas9 comprises the amino acid sequence (SEQ ID NO: 35). In some embodiments, the Cas9 protein is a nuclease active Cas9. In some embodiments, the nuclease active Cas9 comprises the amino acid sequence (SEQ ID NO: 36).

Exemplary catalytically inactive Cas9 (dCas9):
(SEQ ID NO: 34)

DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFL VEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDAIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD

Exemplary Cas9 nickase (nCas9):
(SEQ ID NO: 35)

DKKYSIGLAIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

-continued

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD

Exemplary catalytically active Cas9:
(SEQ ID NO: 36)
DKKYSIGLDIGTNSVGWAVITDEYKVPSKKFKVLGNTDRHSIKKNLIGALLFDSGETA

EATRLKRTARRRYTRRKNRICYLQEIFSNEMAKVDDSFFHRLEESFLVEEDKKHERH

PIFGNIVDEVAYHEKYPTIYHLRKKLVDSTDKADLRLIYLALAHMIKFRGHFLIEGDL

NPDNSDVDKLFIQLVQTYNQLFEENPINASGVDAKAILSARLSKSRRLENLIAQLPGE

KKNGLFGNLIALSLGLTPNFKSNFDLAEDAKLQLSKDTYDDDLDNLLAQIGDQYADL

FLAAKNLSDAILLSDILRVNTEITKAPLSASMIKRYDEHHQDLTLLKALVRQQLPEKY

KEIFFDQSKNGYAGYIDGGASQEEFYKFIKPILEKMDGTEELLVKLNREDLLRKQRTF

DNGSIPHQIHLGELHAILRRQEDFYPFLKDNREKIEKILTFRIPYYVGPLARGNSRFAW

MTRKSEETITPWNFEEVVDKGASAQSFIERMTNFDKNLPNEKVLPKHSLLYEYFTVY

NELTKVKYVTEGMRKPAFLSGEQKKAIVDLLFKTNRKVTVKQLKEDYFKKIECFDS

VEISGVEDRFNASLGTYHDLLKIIKDKDFLDNEENEDILEDIVLTLTLFEDREMIEERL

KTYAHLFDDKVMKQLKRRRYTGWGRLSRKLINGIRDKQSGKTILDFLKSDGFANRN

FMQLIHDDSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEHPVENTQL

QNEKLYLYYLQNGRDMYVDQELDINRLSDYDVDHIVPQSFLKDDSIDNKVLTRSDK

NRGKSDNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKDFQFYKV

REINNYHHAHDAYLNAVVGTALIKKYPKLESEFVYGDYKVYDVRKMIAKSEQEIGK

ATAKYFFYSNIMNFFKTEITLANGEIRKRPLIETNGETGEIVWDKGRDFATVRKVLSM

```
PQVNIVKKTEVQTGGFSKESILPKRNSDKLIARKKDWDPKKYGGFDSPTVAYSVLVV

AKVEKGKSKKLKSVKELLGITIMERSSFEKNPIDFLEAKGYKEVKKDLIIKLPKYSLFE

LENGRKRMLASAGELQKGNELALPSKYVNFLYLASHYEKLKGSPEDNEQKQLFVEQ

HKHYLDEIIEQISEFSKRVILADANLDKVLSAYNKHRDKPIREQAENIIHLFTLTNLGA

PAAFKYFDTTIDRKRYTSTKEVLDATLIHQSITGLYETRIDLSQLGGD.
```

In some embodiments, Cas9 refers to a Cas9 from arehaea (e.g. nanoarchaea), which constitute a domain and kingdom of single-celled prokaryotic microbes. In some embodiments, Cas9 refers to CasX or CasY, which have been described in, for example, Burstein et al., "New CRISPR-Cas systems from uncultivated microbes." *Cell Res.* 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp) and are within the scope of this disclosure.

In some embodiments, the nucleic acid programmable DNA binding protein (napDNAbp) of any of the fusion proteins provided herein may be a CasX or CasY protein. In some embodiments, the napDNAbp is a CasX protein. In some embodiments, the napDNAbp is a CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 417-419. In some embodiments, the napDNAbp comprises an amino acid sequence of any one SEQ ID NOs: 417-419. It should be appreciated that CasX and CasY from other bacterial species may also be used in accordance with the present disclosure.

```
CasX (uniprot.org/uniprot/F0NN87; uniprot.org/uniprot/F0NH53)
>tr|F0NN87|F0NN87_SULIH CRISPR-associated Casx protein
OS = Sulfolobus islandicus (strain HVE10/4) GN = SiH_0402
PE = 4 SV = 1
                                                      (SEQ ID NO: 417)
MEVPLYNIFGDNYIIQVATEAENSTIYNNKVEIDDEELRNVLNLAYKIAKNNEDAAAE

RRGKAKKKKGEEGETTTSNIILPLSGNDKNPWTETLKCYNFPTTVALSEVFKNFSQV

KECEEVSAPSFVKPEFYEFGRSPGMVERTRRVKLEVEPHYLIIAAAGWVLTRLGKAK

VSEGDYVGVNVFTPTRGILYSLIQNVNGIVPGIKPETAFGLWIARKVVSSVTNPNVSV

VRIYTISDAVGQNPTTINGGFSIDLTKLLEKRYLLSERLEAIARNALSISSNMRERYIVL

ANYIYEYLTGSKRLEDLLYFANRDLIMNLNSDDGKVRDLKLISAYVNGELIRGEG

>tr|F0NH53|F0NH53_SULIR CRISPR associated protein, Casx
OS = Sulfolobus islandicus (strain REY15A) GN = SiRe_0771
PE = 4 SV = 1
                                                      (SEQ ID NO: 418)
MEVPLYNIFGDNYIIQVATEAENSTIYNNKVEIDDEELRNVLNLAYKIAKNNEDAAAE

RRGKAKKKKGEEGETTTSNIILPLSGNDKNPWTETLKCYNFPTTVALSEVFKNFSQV

KECEEVSAPSFVKPEFYKFGRSPGMVERTRRVKLEVEPHYLIMAAAGWVLTRLGKA

KVSEGDYVGVNVFTPTRGILYSLIQNVNGIVPGIKPETAFGLWIARKVVSSVTNPNVS

VVSIYTISDAVGQNPTTINGGFSIDLTKLLEKRDLLSERLEAIARNALSISSNMRERYIV

LANYIYEYLTGSKRLEDLLYFANRDLIMNLNSDDGKVRDLKLISAYVNGELIRGEG

CasY (ncbi.nlm.nih.gov/protein/APG80656.1)
>APG80656.1 CRISPR-associated protein CasY [uncultured
Parcubacteria group bacterium]
                                                      (SEQ ID NO: 419)
MSKRHPRISGVKGYRLHAQRLEYTGKSGAMRTIKYPLYSSPSGGRTVPREIVSAINDD

YVGLYGLSNFDDLYNAEKRNEEKVYSVLDFWYDCVQYGAVESYTAPGLLKNVAEV
```

-continued

```
RGGSYELTKTLKGSHLYDELQIDKVIKFLNKKEISRANGSLDKLKKDIIDCFKAEYRE

RHKDQCNKLADDIKNAKKDAGASLGERQKKLFRDFFGISEQSENDKPSFTNPLNLTC

CLLPFDTVNNNRNRGEVLENKLKEYAQKLDKNEGSLEMWEYIGIGNSGTAFSNFLGE

GFLGRLRENKITELKKAMMDITDAWRGQEQEEELEKRLRILAALTIKLREPKFDNHW

GGYRSDINGKLSSWLQNYINQTVKIKEDLKGHKKDLKKAKEMINRFGESDTKEEAV

VSSLLESIEKIVPDDSADDEKPDIPAIAIYRRFLSDGRLTLNRFVQREDVQEALIKERLE

AEKKKKPKKRKKKSDAEDEKETIDFKELFPHLAKPLKLVPNFYGDSKRELYKKYKN

AAIYTDALWKAVEKIYKSAFSSSLKNSFFDTDFDKDFFIKRLQKIFSVYRRFNTDKWK

PIVKNSFAPYCDIVSLAENEVLYKPKQSRSRKSAAIDKNRVRLPSTENIAKAGIALARE

LSVAGFDWKDLLKKEEHEEYIDLIELHKTALALLLAVTETQLDISALDFVENGTVKD

FMKTRDGNLVLEGRFLEMFSQSIVFSELRGLAGLMSRKEFITRSAIQTMNGKQAELL

YIPHEFQSAKITTPKEMSRAFLDLAPAEFATSLEPESLSEKSLLKLKQMRYYPHYFGY

ELTRTGQGIDGGVAENALRLEKSPVKKREIKCKQYKTLGRGQNKIVLYVRSSYYQTQ

FLEWFLHRPKNVQTDVAVSGSFLIDEKKVKTRWNYDALTVALEPVSGSERVFVSQPF

TIFPEKSAEEEGQRYLGIDIGEYGIAYTALEITGDSAKILDQNFISDPQLKTLREEVKGL

KLDQRRGTFAMPSTKIARIRESLVHSLRNRIHHLALKHKAKIVYELEVSRFEEGKQKI

KKVYATLKKADVYSEIDADKNLQTTVWGKLAVASEISASYTSQFCGACKKLWRAE

MQVDETITTQELIGTVRVIKGGTLIDAIKDFMRPPIFDENDTPFPKYRDFCDKHHISKK

MRGNSCLFICPFCRANADADIQASQTIALLRYVKEEKKVEDYFERFRKLKNIKVLGQ

MKKI
```

The term "effective amount," as used herein, refers to an amount of a biologically active agent that is sufficient to elicit a desired biological response. For example, in some embodiments, an effective amount of a nucleobase editor may refer to the amount of the nucleobase editor that is sufficient to induce mutation of a target site specifically bound mutated by the nucleobase editor. In some embodiments, an effective amount of a fusion protein provided herein, e.g., of a fusion protein comprising a nucleic acid programmable DNA binding protein and a deaminase domain (e.g., an adenosine deaminase domain) may refer to the amount of the fusion protein that is sufficient to induce editing of a target site specifically bound and edited by the fusion protein. As will be appreciated by the skilled artisan, the effective amount of an agent, e.g., a fusion protein, a nucleobase editor, a deaminase, a hybrid protein, a protein dimer, a complex of a protein (or protein dimer) and a polynucleotide, or a polynucleotide, may vary depending on various factors as, for example, on the desired biological response, e.g., on the specific allele, genome, or target site to be edited, on the cell or tissue being targeted, and on the agent being used.

The terms "nucleic acid" and "nucleic acid molecule," as used herein, refer to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g., analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, 0(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to as cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. The term "fusion protein" as used herein refers to a hybrid polypeptide which comprises protein domains from at least two different proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. In some embodiments, a protein comprises a proteinaceous part, e.g., an amino acid sequence constituting a nucleic acid binding domain, and an organic compound, e.g., a compound that can act as a nucleic acid cleavage agent. In some embodiments, a protein is in a complex with, or is in association with, a nucleic acid, e.g., RNA. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* (4$^{th}$ ed., Cold Spring Harbor Laboratory Press, Cold Spring Harbor, N.Y. (2012)), the entire contents of which are incorporated herein by reference.

The term "RNA-programmable nuclease," and "RNA-guided nuclease" are used interchangeably herein and refer to a nuclease that forms a complex with (e.g., binds or associates with) one or more RNA(s) that is not a target for cleavage. In some embodiments, an RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeably to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 complex to the target); and (2) a domain that binds a Cas9 protein. In some embodiments, domain (2) corresponds to a sequence known as a tracrRNA and comprises a stem-loop structure. For example, in some embodiments, domain (2) is identical or homologous to a tracrRNA as provided in Jinek et al., *Science* 337:816-821(2012), the entire contents of which is incorporated herein by reference. Other examples of gRNAs (e.g., those including domain 2) can be found in U.S. Provisional Patent Application, U.S. Ser. No. 61/874,682, filed Sep. 6, 2013, entitled "Switchable Cas9 Nucleases And Uses Thereof," and U.S. Provisional Patent Application, U.S. Ser. No. 61/874,746, filed Sep. 6, 2013, entitled "Delivery System For Functional Nucleases," the entire contents of each are hereby incorporated by reference in their entirety. In some embodiments, a gRNA comprises two or more of domains (1) and (2) and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example, Cas9 (Csn1) from *Streptococcus pyogenes* (see, e.g., "Complete genome sequence of an M1 strain of *Streptococcus pyogenes*." Ferretti J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference.

Because RNA-programmable nucleases (e.g., Cas9) use RNA: DNA hybridization to target DNA cleavage sites, these proteins are able to be targeted, in principle, to any sequence specified by the guide RNA. Methods of using RNA-programmable nucleases, such as Cas9, for site-specific cleavage (e.g., to modify a genome) are known in the art (see e.g., Cong, L. et al., Multiplex genome engineering using CRISPR/Cas systems. *Science* 339, 819-823 (2013); *Mali*, P. et al., RNA-guided human genome engineering via Cas9. *Science* 339, 823-826 (2013); Hwang, W. Y. et al., Efficient genome editing in zebrafish using a CRISPR-Cas system. *Nature biotechnology* 31, 227-229 (2013); Jinek, M.

et al., RNA-programmed genome editing in human cells. *eLife* 2, e00471 (2013); Dicarlo, J. E. et al., Genome engineering in *Saccharomyces cerevisiae* using CRISPR-Cas systems. *Nucleic acids research* (2013); Jiang, W. et al. RNA-guided editing of bacterial genomes using CRISPR-Cas systems. *Nature biotechnology* 31, 233-239 (2013); the entire contents of each of which are incorporated herein by reference).

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g., a genetically engineered non-human subject. The subject may be of either sex and at any stage of development.

The term "target site" refers to a sequence within a nucleic acid molecule that is deaminated by a deaminase or a fusion protein comprising a deaminase, (e.g., a dCas9-adenosine deaminase fusion protein provided herein).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example, to prevent or delay their recurrence.

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

DETAILED DESCRIPTION OF THE INVENTION

Some aspects of this disclosure relate to proteins that deaminate the nucleobase adenine. This disclosure provides adenosine deaminase proteins that are capable of deaminating (i.e., removing an amine group) adenine of a deoxyadenosine residue in deoxyribonucleic acid (DNA). For example, the adenosine deaminases provided herein are capable of deaminating adenine of a deoxyadenosine residue of DNA. It should be appreciated that there were no known adenosine deaminases capable of deaminating deoxyadenosine in DNA before the present invention. Other aspects of the disclosure provide fusion proteins that comprise an adenosine deaminase (e.g., an adenosine deaminase that deaminates deoxyadenosine in DNA as described herein) and a domain (e.g., a Cas9 or a Cpf1 protein) capable of binding to a specific nucleotide sequence. The deamination of an adenosine by an adenosine deaminase can lead to a point mutation, this process is referred to herein as nucleic acid editing. For example, the adenosine may be converted to an inosine residue, which typically base pairs with a cytosine residue. Such fusion proteins are useful inter alia for targeted editing of nucleic acid sequences. Such fusion proteins may be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a subject. As an example, diseases that can be treated by making an A to G, or a T to C mutation may be treated using the nucleobase editors provided herein. The invention provides deaminases, fusion proteins, nucleic acids, vectors, cells, compositions, methods, kits, systems, etc. that utilize the deaminases and nucleobase editors.

In some embodiments, the nucleobase editors provided herein can be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein may comprise a Cas9 domain that has reduced nuclease activity. In some embodiments, the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand. In some embodiments, any of the fusion proteins provided herein further comprise an inhibitor of inosine base excision repair, for example, a uracil glycosylase inhibitor (UGI) domain or a catalytically inactive inosine-specific nuclease (dISN). Without wishing to be bound by any particular theory, the UGI domain or dISN may inhibit or prevent base excision repair of a deaminated adenosine residue (e.g., inosine), which may improve the activity or efficiency of the base editor.

Adenosine Deaminases

Some aspects of the disclosure provide adenosine deaminases. In some embodiments, the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., *E. coli*). In some embodiments, the adenine deaminase is a naturally-occurring adenosine deaminase that includes one or more mutations corresponding to any of the mutations provided herein (e.g., mutations in ecTadA). One of skill in the art will be able to identify the corresponding residue in any homologous protein and in the respective encoding nucleic acid by methods well known in the art, e.g., by sequence alignment and determination of homologous residues. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Salmonella typhi, Shewanella putrefaciens, Haemophilus influenzae, Caulobacter crescentus*, or *Bacillus subtilis*. In some embodiments, the adenosine deaminase is from *E. coli*.

Figure 92:
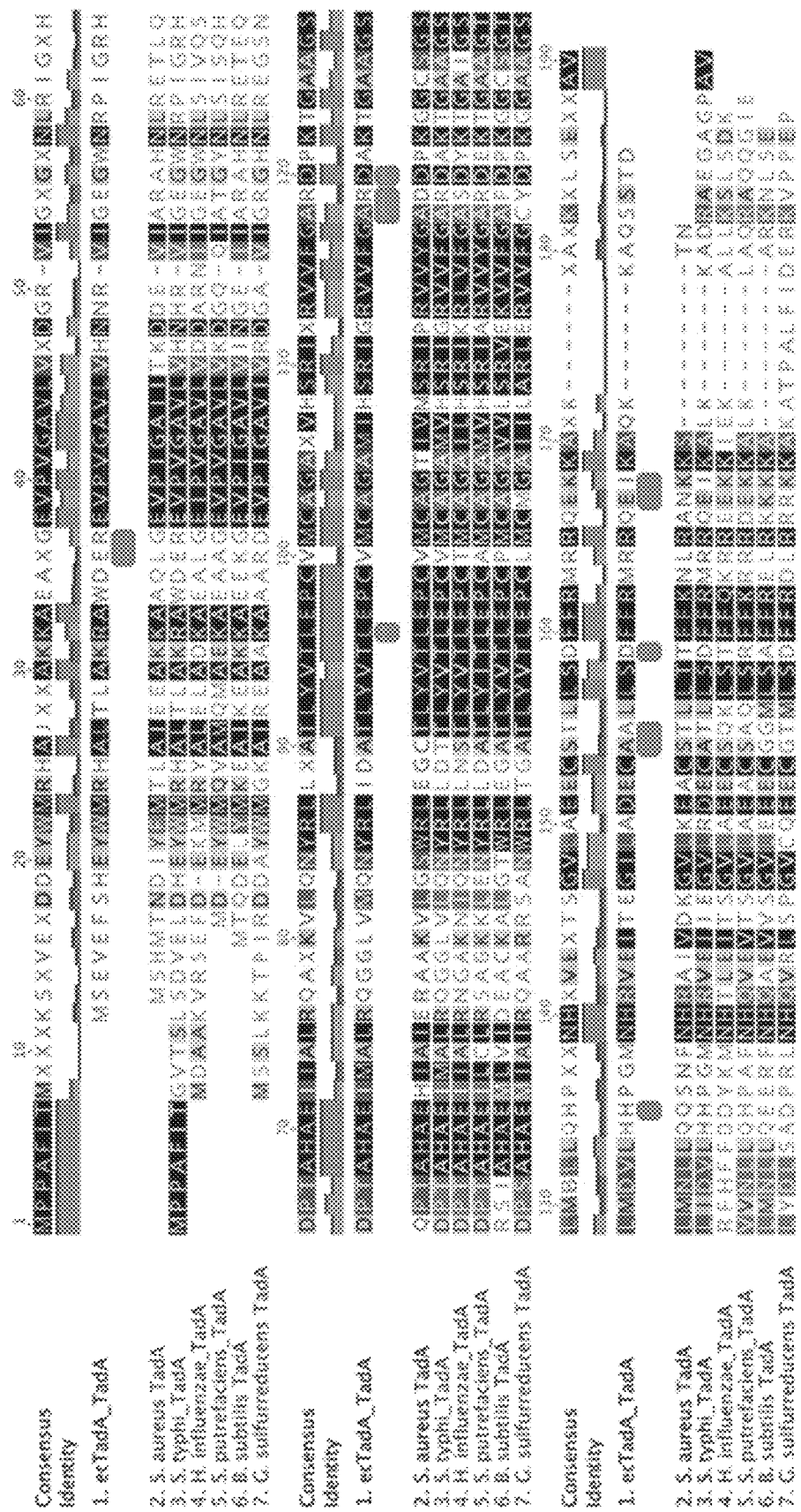
FIG. 92 shows a sequence alignment of prokaryotic TadA amino acid sequences. The sequences correspond to SEQ ID NOs: 634-657 from top to bottom respectively.
Figure 93:
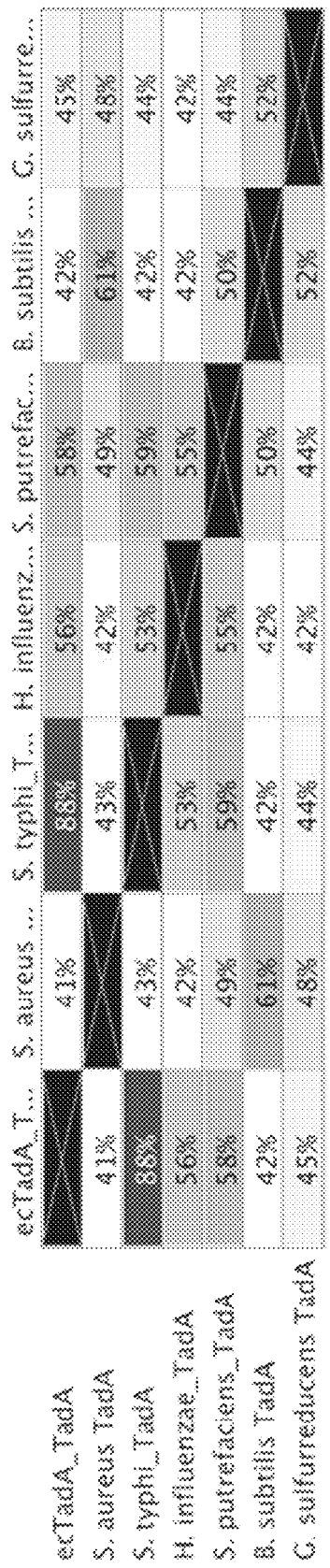
FIG. 93 shows a schematic of the relative sequence identity analysis of TadA amino acid sequences.

Exemplary alignment of prokaryotic TadA proteins is shown in FIG. 92. The residues highlighted in blue are the residues which may be important for catalyzing A to I deamination on ssDNA. Accordingly, it should be appreciated that any of the mutations identified in ecTadA provided herein may be made in any homologous residue in another adenine deaminase, for example, a TadA deaminase from another bacterium. FIG. 93 shows the relative sequence identity analysis (heatmap of sequence identity):

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. It should be appreciated that adenosine deaminases provided herein may include one or more mutations (e.g., any of the mutations provided herein). The disclosure provides any deaminase domains with a certain percent identity plus any of the mutations or combinations thereof described herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 1, 64-84, 420-437, 672-684, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 1, 64-84, 420-437, 672-684, or any of the adenosine deaminases provided herein.

Evolution #1 and #2 Mutations

In some embodiments, the adenosine deaminase comprises a D108X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a D108G, D108N, D108V, D108A, or D108Y mutation in SEQ ID NO: 1, or a corresponding mutation in another adenosine deaminase. An exemplary alignment of deami-nases is shown in FIG. 92. It should be appreciated, however, that additional deaminases may similarly be aligned to identify homologous amino acid residues that can be mutated as provided herein.

In some embodiments, the adenosine deaminase comprises an A106X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 1, or a corresponding mutation in another adenosine deaminase.

In some embodiments, the adenosine deaminase comprises a E155X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a E155D, E155G, or E155V mutation in SEQ ID NO: 1, or a corresponding mutation in another adenosine deaminase.

In some embodiments, the adenosine deaminase comprises a D147X mutation in SEQ ID NO: 1, or a corresponding mutation in another adenosine deaminase, where the presence of X indicates any amino acid other than the corresponding amino acid in the wild-type adenosine deaminase. In some embodiments, the adenosine deaminase comprises a D147Y, mutation in SEQ ID NO: 1, or a corresponding mutation in another adenosine deaminase.

It should be appreciated that any of the mutations provided herein (e.g., based on the ecTadA amino acid sequence of SEQ ID NO: 1) may be introduced into other adenosine deaminases, such as *S. aureus* TadA (saTadA), or other adenosine deaminases (e.g., bacterial adenosine deaminases). It would be apparent to the skilled artisan how to identify amino acid residues from other adenosine deaminases that are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, a E155V, and/or a D147Y mutation in ecTadA SEQ ID NO: 1, or a corresponding mutation in another adenosine deaminase. In some embodiments, an adenosine deaminase comprises the following group of mutations (groups of mutations are separated by a ";") in ecTadA SEQ ID NO: 1, or corresponding mutations in another adenosine deaminase:

D108N and A106V; D108N and E155V; D108N and D147Y; A106V and E155V; A106V and D147Y; E155V and D147Y; D108N, A106V, and E55V; D108N, A106V, and D147Y; D108N, E55V, and D147Y; A106V, E55V, and D147Y; and D108N, A106V, E55V, and D147Y. It should be appreciated, however, that any combination of corresponding mutations provided herein may be made in an adenosine deaminase (e.g., ecTadA). In some embodiments, an adenosine deaminase comprises one or more of the mutations shown in Table 4, which identifies individual mutations and combinations of mutations made in ecTadA and saTadA. In some embodiments, an adenosine deaminase comprises a mutation or combination of mutations shown in Table 4.

In some embodiments, the adenosine deaminase comprises one or more of a H8X, T17X, L18X, W23X, L34X, W45X, R51X, A56X, E59X, E85X, M94X, I95X, V102X, F104X, A106X, R107X, D108X, K110X, M118X, N127X, A138X, F149X, M151X, R153X, Q154X, I156X, and/or K157X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H8Y, T17S, L18E, W23L, L34S, W45L, R51H, A56E, or A56S, E59G, E85K, or E85G, M94L, I95I, V102A, F104L, A106V, R107C, or R107H, or R107P, D108G, or D108N, or D108V, or D108A, or D108Y, K110I, M118K, N127S, A138V, F149Y, M151V, R153C, Q154L, I156D, and/or K157R mutation in SEQ ID NO: 1, or one or more corresponding mutations in another adenosine deaminase. In some embodiments, the adenosine deaminase comprises one or more of the mutations provided in FIG. 11 corresponding to SEQ ID NO: 1, or one or more corresponding mutations in another adenosine deaminase. In some embodiments, the adenosine deaminase comprises the mutation or mutations of any one of constructs 1-16 shown in FIG. 11 or in any one of the constructs shown in Table 4 corresponding to SEQ ID NO: 1, or a corresponding mutation or mutations in another adenosine deaminase.

In some embodiments, the adenosine deaminase comprises one or more of a H8X, D108X, and/or N127X mutation in SEQ ID NO: 1, or one or more corresponding mutations in another adenosine deaminase, where X indicates the presence of any amino acid. In some embodiments, the adenosine deaminase comprises one or more of a H8Y, D108N, and/or N127S mutation in SEQ ID NO: 1, or one or more corresponding mutations in another adenosine deaminase.

In some embodiments, the adenosine deaminase comprises one or more of H8X, R26X, M61X, L68X, M70X, A106X, D108X, A109X, N127X, D147X, R152X, Q154X, E155X, K161X, Q163X, and/or T166X mutation in SEQ ID NO: 1, or one or more corresponding mutations in another adenosine deaminase, where X indicates the presence of any amino acid other than the corresponding amino acid in the wild-type adenosine deaminase. In some embodiments, the adenosine deaminase comprises one or more of H8Y, R26W, M61I, L68Q, M70V, A106T, D108N, A109T, N127S, D147Y, R152C, Q154H or Q154R, E155G or E155V or E155D, K161Q, Q163H, and/or T166P mutation in SEQ ID NO: 1, or one or more corresponding mutations in another adenosine deaminase.

In some embodiments, the adenosine deaminase comprises one, two, three, four, five, or six mutations selected from the group consisting of H8X, D108X, N127X, D147X, R152X, and Q154X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, M61X, M70X, D108X, N127X, Q154X, E155X, and Q163X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, N127X, E155X, and T166X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8X, A106X, D108X, N127X, E155X, and K161X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, six, seven, or eight mutations selected from the group consisting of H8X, R126X, L68X, D108X, N127X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, D108X, A109X, N127X, and E155X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, or six mutations selected from the group consisting of H8Y, D108N, N127S, D147Y, R152C, and Q154H in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, M61I, M70V, D108N, N127S, Q154R, E155G and Q163H in SEQ ID NO: 1, or a corresponding mutation or mutations in another adenosine deaminase. In some embodiments, the adenosine deaminase comprises one, two, three, four, or five, mutations selected from the group consisting of H8Y, D108N, N127S, E155V, and T166P in SEQ ID NO: 1, or a corresponding mutation or mutations in another adenosine deaminase. In some embodiments, the adenosine deaminase comprises one, two, three, four, five, or six mutations selected from the group consisting of H8Y, A106T, D108N, N127S, E155D, and K161Q in SEQ ID NO: 1, or a corresponding mutation or mutations in another adenosine deaminase. In some embodiments, the adenosine deaminase comprises one, two, three, four, five, six, seven, or eight mutations selected from the group consisting of H8Y, R126W, L68Q, D108N, N127S, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, D108N, A109T, N127S, and E155G in SEQ ID NO: 1, or a corresponding mutation or mutations in another adenosine deaminase.

In some embodiments, the adenosine deaminase comprises one or more of the mutations provided in FIG. 16 corresponding to SEQ ID NO: 1, or one or more corresponding mutations in another adenosine deaminase. In some embodiments, the adenosine deaminase comprises the mutations of any one of constructs pNMG-149 to pNMG-154 of FIG. 16, corresponding to SEQ ID NO: 1, or corresponding mutations in another adenosine deaminase. In some embodiments, the adenosine deaminase comprises a D108N, D108G, or D108V mutation in SEQ ID NO: 1, or corresponding mutations in another adenosine deaminase. In some embodiments, the adenosine deaminase comprises a A106V and D108N mutation in SEQ ID NO: 1, or corresponding mutations in another adenosine deaminase. In some embodiments, the adenosine deaminase comprises R107C and D108N mutations in SEQ ID NO: 1, or corresponding mutations in another adenosine deaminase. In some embodiments, the adenosine deaminase comprises a H8Y, D108N, N127S, D147Y, and Q154H mutation in SEQ ID NO: 1, or corresponding mutations in another adenosine deaminase. In some embodiments, the adenosine deaminase comprises a H8Y, R24W, D108N, N127S, D147Y, and E155V mutation in SEQ ID NO: 1, or corresponding mutations in another adenosine deaminase. In some embodiments, the adenosine deaminase comprises a D108N, D147Y, and E155V mutation in SEQ ID NO: 1, or corresponding mutations in another adenosine deaminase. In some embodiments, the adenosine deaminase comprises a H8Y, D108N, and S127S mutation in SEQ ID NO: 1, or corresponding mutations in another adenosine deaminase. In some embodiments, the adenosine deaminase comprises a A106V, D108N, D147Y and E155V mutation in SEQ ID NO: 1, or corresponding mutations in another adenosine deaminase.

Figures 96, 97:
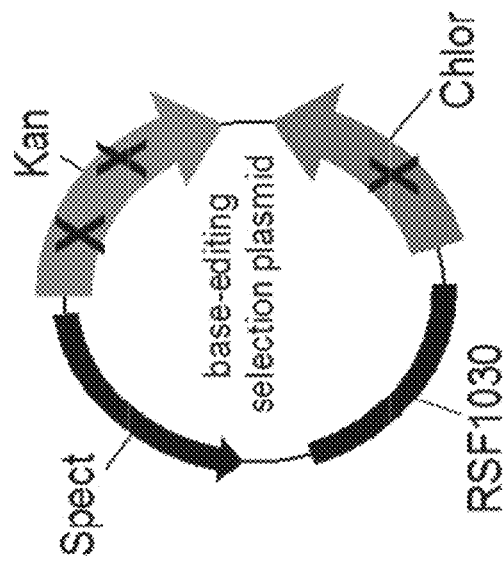
FIG. 96 shows a schematic of an exemplary base-editing selection plasmid.
FIG. 97 shows a list of clones including identified mutations in ecTadA.
Figure 98:
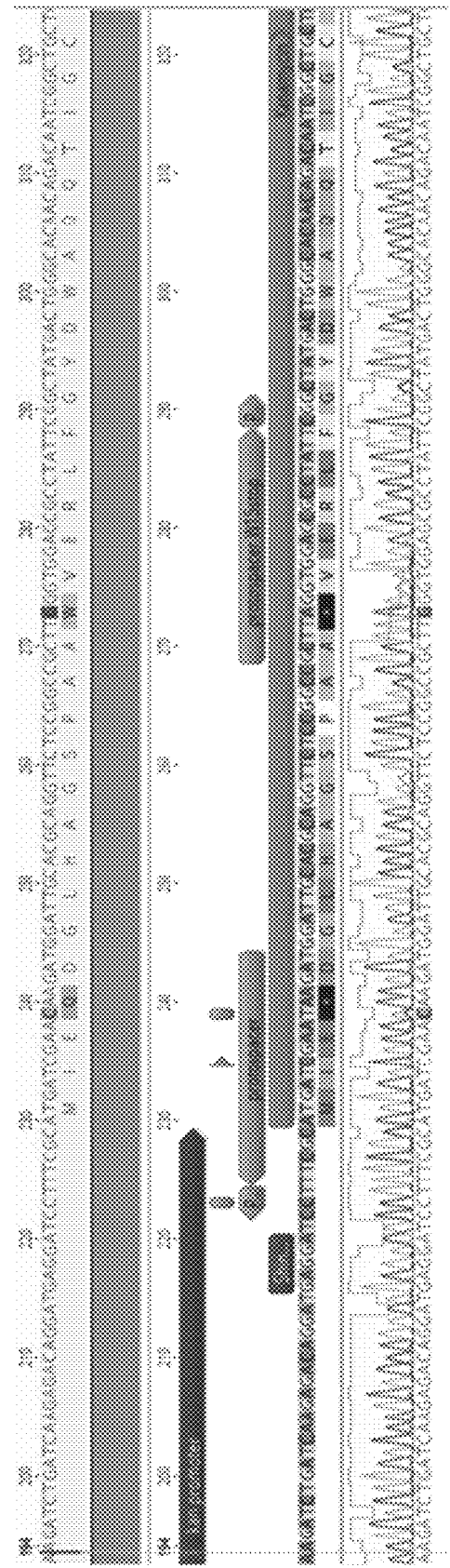
FIG. 98 shows an exemplary sequencing analysis of a selection plasmid from surviving colonies. The sequences correspond to SEQ ID NOs: 658-661, 5529-5530, and 662 from top to bottom and left to right, respectively.
Figures 99, 100:
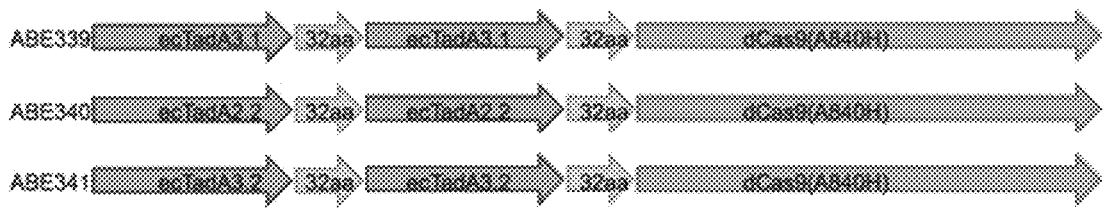
FIG. 99 shows schematic of exemplary adenosine base editors from a third round of evolution.
FIG. 100 shows the percentage of A to G conversions in Hek293T cells.
Figure 101:
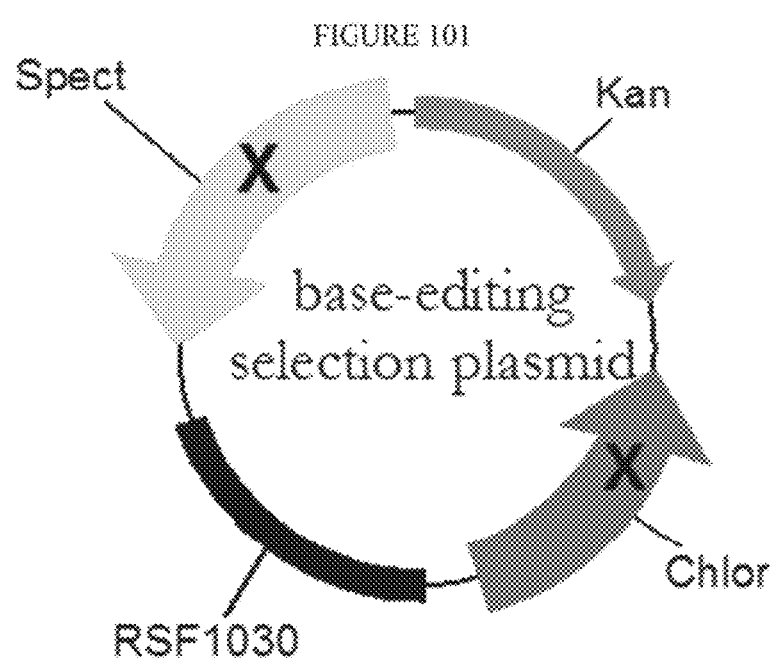
FIG. 101 shows a schematic of an exemplary base-editing selection plasmid.
Figure 102:
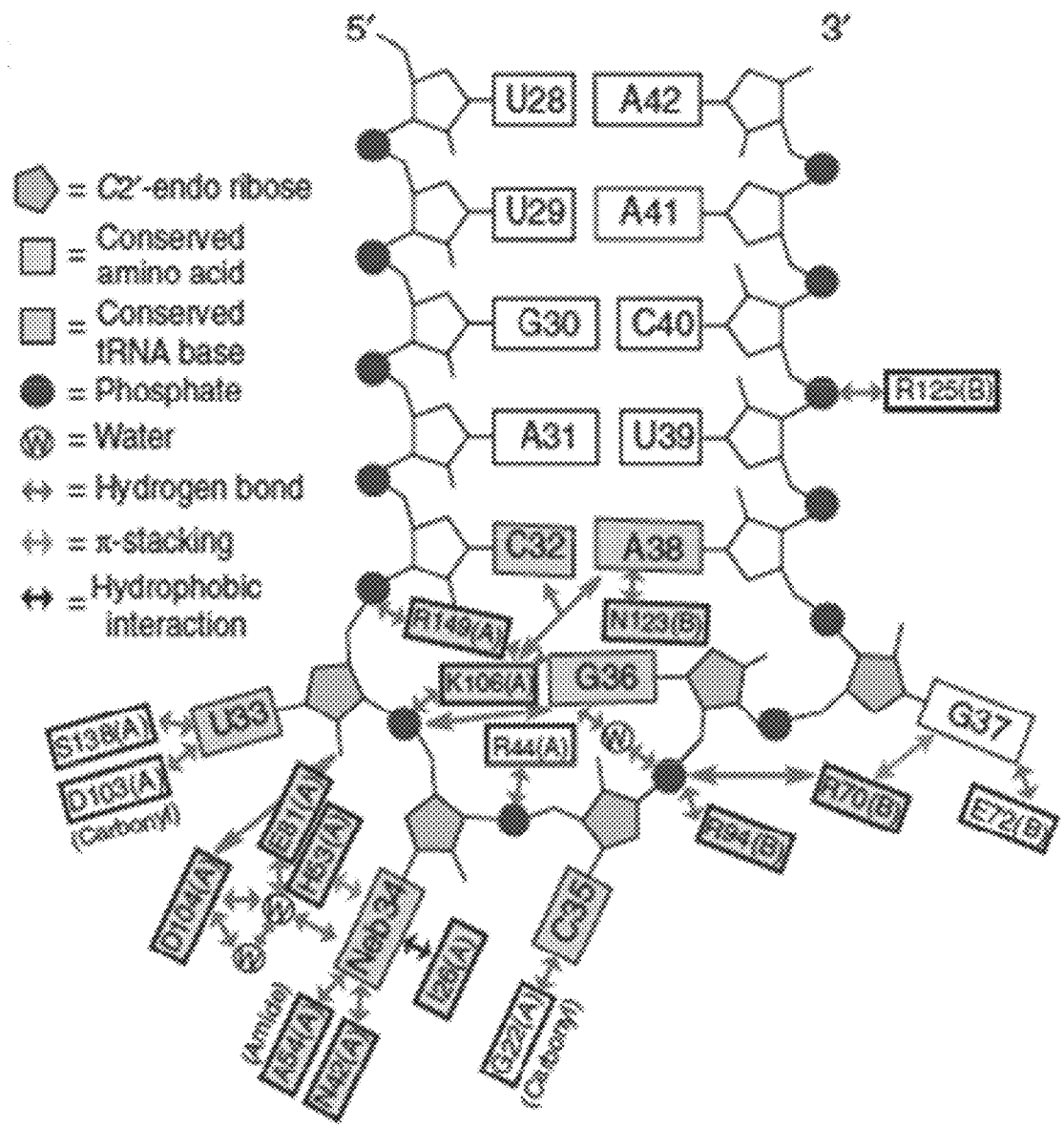
FIG. 102 shows a schematic representation of the verdine crystal structure of *S. aureus* TadA. The *S. aureus* TadA, a homolog of ecTadA, is shown with its tRNA substrate co-crystalized. Red arrows are the H-bond contacts with the various nucleic acids in the tRNA substrate. See Losey, H. C., et al., "Crystal structure of *Staphylococcus aureus* tRNA adenosine deaminase tadA in complex with RNA", Nature Struct. Mol. Biol. 2, 153-159 (2006).
Figure 103:
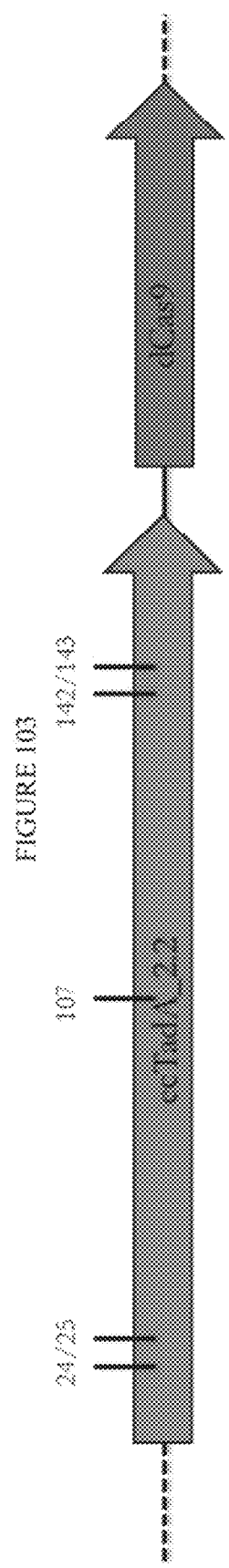
FIG. 103 shows a schematic of a construct containing ecTadA_2.2 and dCas9, identifying mutated ecTadA residues.
Figure 104:
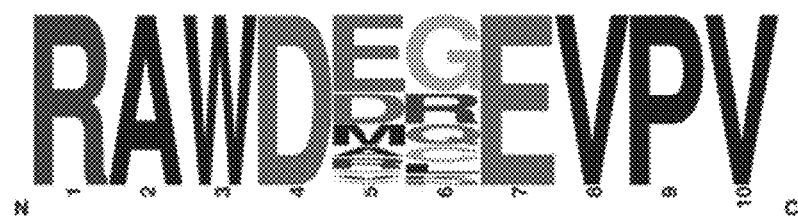
FIG. 104 shows results of ecTadA evolution (evolution #4) at sites E25 and R26.
Figure 105:
FIG. 105 shows results of ecTadA evolution (evolution #4) at site R107.
Figure 106:
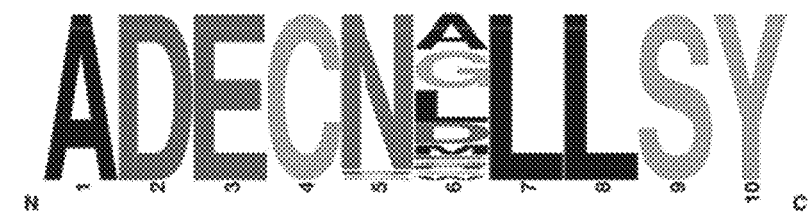
FIG. 106 shows results of ecTadA evolution (evolution #4) at sites A142 and A143.
Figure 107:
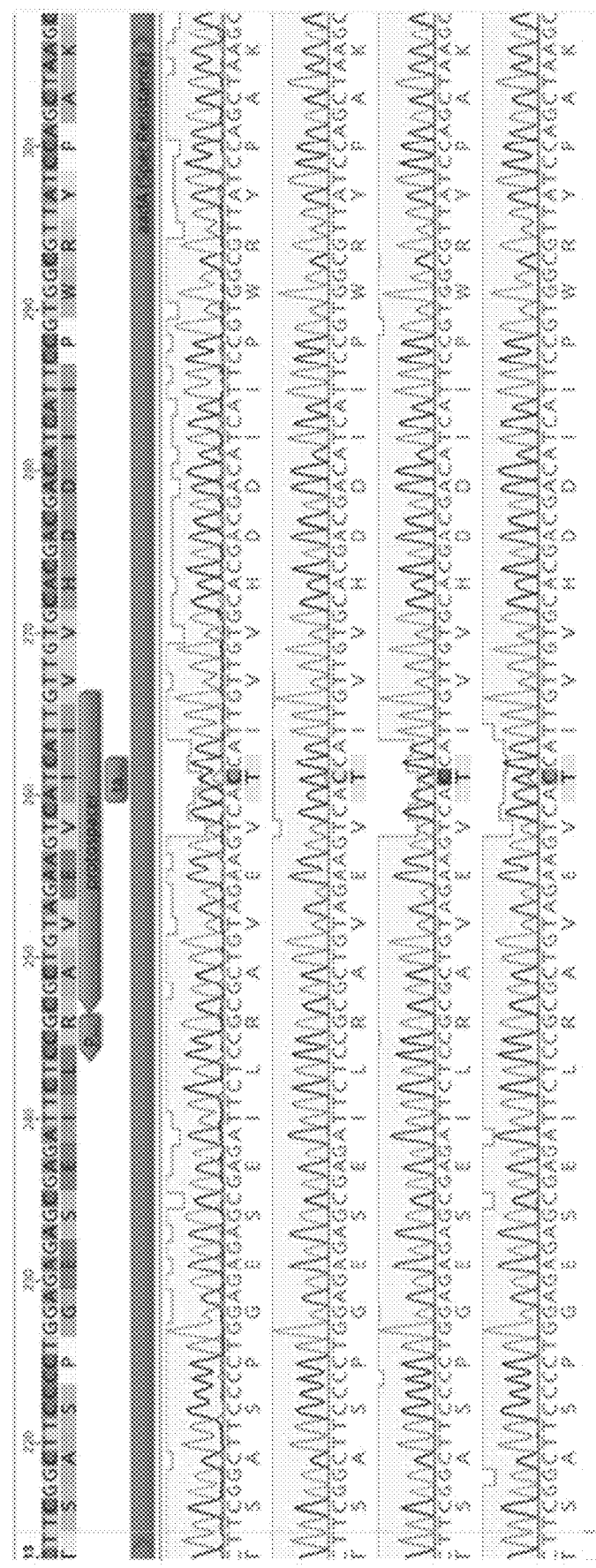
FIG. 107 shows an exemplary sequencing analysis of a selection plasmid from surviving colonies. The sequences correspond to SEQ ID NO: 662-671 from top to bottom respectively.
Figure 122:
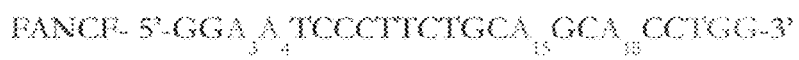

In some embodiments, the adenosine deaminase comprises one or more of a, S2X, H8X, I49X, L84X, H123X, N127X, I156X and/or K160X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of S2A, H8Y, I49F, L84F, H123Y, N127S, I156F and/or K160S mutation in SEQ ID NO: 1, or one or more corresponding mutations in another adenosine deaminase. In some embodiments, the adenosine deaminase comprises one or more of the mutations provided in FIG. 97 corresponding to SEQ ID NO: 1, or one or more corresponding mutations in another adenosine deaminase. In some embodiments, the adenosine deaminase comprises the mutation or mutations of any one of clones 1-3 shown in FIG. 97 corresponding to SEQ ID NO: 1, or a corresponding mutation or mutations in another adenosine deaminase.

In some embodiments, the adenosine deaminase comprises an L84X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an L84F mutation in SEQ ID NO: 1, or a corresponding mutation in another adenosine deaminase.

In some embodiments, the adenosine deaminase comprises an H123X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H123Y mutation in SEQ ID NO: 1, or a corresponding mutation in another adenosine deaminase.

In some embodiments, the adenosine deaminase comprises an I157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an I157F mutation in SEQ ID NO: 1, or a corresponding mutation in another adenosine deaminase.

In some embodiments, the adenosine deaminase comprises one, two, three, four, five, six, or seven mutations selected from the group consisting of L84X, A106X, D108X, H123X, D147X, E155X, and I156X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, five, or six mutations selected from the group consisting of S2X, I49X, A106X, D108X, D147X, and E155X in SEQ ID NO: 1, or a corresponding mutation or mutations in another adenosine deaminase, where X indicates the presence of any amino acid other than the corresponding amino acid in the wild-type adenosine deaminase. In some embodiments, the adenosine deaminase comprises one, two, three, four, or five, mutations selected from the group consisting of H8X, A106X, D108X, N127X, and K160X in SEQ ID NO: 1, or a corresponding mutation or mutations in another adenosine deaminase, where X indicates the presence of any amino acid other than the corresponding amino acid in the wild-type adenosine deaminase.

In some embodiments, the adenosine deaminase comprises one, two, three, four, five, six, or seven mutations selected from the group consisting of L84F, A106V, D108N, H123Y, D147Y, E155V, and I156F in SEQ ID NO: 1, or a corresponding mutation or mutations in another adenosine deaminase. In some embodiments, the adenosine deaminase comprises one, two, three, four, five, or six mutations selected from the group consisting of S2A, I49F, A106V, D108N, D147Y, and E155V in SEQ ID NO: 1, or a corresponding mutation or mutations in another adenosine deaminase. In some embodiments, the adenosine deaminase comprises one, two, three, four, or five, mutations selected from the group consisting of H8Y, A106T, D108N, N127S, and K160S in SEQ ID NO: 1, or a corresponding mutation or mutations in another adenosine deaminase.

In some embodiments, the adenosine deaminase comprises one or more of a, E25X, R26X, R107X, A142X, and/or A143X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of E25M, E25D, E25A, E25R, E25V, E25S, E25Y, R26G, R26N, R26Q, R26C, R26L, R26K, R107P, R07K, R107A, R107N, R107W, R107H, R107S, A142N, A142D, A142G, A143D, A143G, A143E, A143L, A143W, A143M, A143S, A143Q and/or A143R mutation in SEQ ID NO: 1, or one or more corresponding mutations in another adenosine deaminase. In some embodiments, the adenosine deaminase comprises one or more of the mutations provided in Table 7 corresponding to SEQ ID NO: 1, or one or more corresponding mutations in another adenosine deaminase. In some embodiments, the adenosine deaminase comprises the mutation or mutations of any one of clones 1-22 shown in Table 7 corresponding to SEQ ID NO: 1, or a corresponding mutation or mutations in another adenosine deaminase.

In some embodiments, the adenosine deaminase comprises an E25X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an E25M, E25D, E25A, E25R, E25V, E25S, or E25Y mutation in SEQ ID NO: 1, or a corresponding mutation in another adenosine deaminase.

In some embodiments, the adenosine deaminase comprises an R26X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an, R26G, R26N, R26Q, R26C, R26L, or R26K mutation in SEQ ID NO: 1, or a corresponding mutation in another adenosine deaminase.

In some embodiments, the adenosine deaminase comprises an R107X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R107P, R07K, R107A, R107N, R107W, R107H, or R107S mutation in SEQ ID NO: 1, or a corresponding mutation in another adenosine deaminase.

In some embodiments, the adenosine deaminase comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A142N, A142D, A142G, mutation in SEQ ID NO: 1, or a corresponding mutation in another adenosine deaminase.

In some embodiments, the adenosine deaminase comprises an A143X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an A143D, A143G, A143E, A143L, A143W, A143M, A143S, A143Q and/or A143R mutation in SEQ ID NO: 1, or a corresponding mutation in another adenosine deaminase.

In some embodiments, the adenosine deaminase comprises one or more of a, H36X, N37X, P48X, I49X, R51X, M70X, N72X, D77X, E134X, S146X, Q154X, K157X, and/or K161X mutation in SEQ ID NO: 1, or one or more corresponding mutations in another adenosine deaminase, where the presence of X indicates any amino acid other than the corresponding amino acid in the wild-type adenosine deaminase. In some embodiments, the adenosine deaminase comprises one or more of H36L, N37T, N37S, P48T, P48L, I49V, R51H, R51L, M70L, N72S, D77G, E134G, S146R, S146C, Q154H, K157N, and/or K161T mutation in SEQ ID NO: 1, or one or more corresponding mutations in another adenosine deaminase. In some embodiments, the adenosine deaminase comprises one or more of the mutations provided in any one of FIGS. 125-128 corresponding to SEQ ID NO: 1, or one or more corresponding mutations in another adenosine deaminase. In some embodiments, the adenosine deaminase comprises the mutation or mutations of any one of clones 1-11 shown in any one of FIGS. 125-128 corresponding to SEQ ID NO: 1, or a corresponding mutation or mutations in another adenosine deaminase.

In some embodiments, the adenosine deaminase comprises an H36X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an H36L mutation in SEQ ID NO: 1, or a corresponding mutation in another adenosine deaminase.

In some embodiments, the adenosine deaminase comprises an N37X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an N37T, or N37S mutation in SEQ ID NO: 1, or a corresponding mutation in another adenosine deaminase.

In some embodiments, the adenosine deaminase comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an P48T, or P48L mutation in SEQ ID NO: 1, or a corresponding mutation in another adenosine deaminase.

In some embodiments, the adenosine deaminase comprises an R51X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an R51H, or R51L mutation in SEQ ID NO: 1, or a corresponding mutation in another adenosine deaminase.

In some embodiments, the adenosine deaminase comprises an S146X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises an S146R, or S146C mutation in SEQ ID NO: 1, or a corresponding mutation in another adenosine deaminase.

In some embodiments, the adenosine deaminase comprises an K157X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a K157N mutation in SEQ ID NO: 1, or a corresponding mutation in another adenosine deaminase.

In some embodiments, the adenosine deaminase comprises an P48X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a P48S, P48T, or P48A mutation in SEQ ID NO: 1, or a corresponding mutation in another adenosine deaminase.

In some embodiments, the adenosine deaminase comprises an A142X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a A142N mutation in SEQ ID NO: 1, or a corresponding mutation in another adenosine deaminase.

In some embodiments, the adenosine deaminase comprises an W23X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a W23R, or W23L mutation in SEQ ID NO: 1, or a corresponding mutation in another adenosine deaminase.

In some embodiments, the adenosine deaminase comprises an R152X mutation in ecTadA SEQ ID NO: 1, or a corresponding mutation in another adenosine deaminase, where X indicates any amino acid other than the corresponding amino acid in the wild-type adenosine deaminase. In some embodiments, the adenosine deaminase comprises a R152P, or R52H mutation in SEQ ID NO: 1, or a corresponding mutation in another adenosine deaminase.

It should be appreciated that the adenosine deaminase (e.g., a first or second adenosine deaminase) may comprise one or more of the mutations provided in any of the adenosine deaminases (e.g., ecTadA adenosine deaminases) shown in Table 4. In some embodiments, the adenosine deaminase comprises the combination of mutations of any of the adenosine deaminases (e.g., ecTadA adenosine deaminases) shown in Table 4. For example, the adenosine deaminase may comprise the mutations H36L, R51L, L84F, A106V, D108N, H123Y, S146C, D147Y, E155V, I156F, and K157N, which are shown in the second ecTadA (relative to SEQ ID NO: 1) of clone pNMG-477. In some embodiments, the adenosine deaminase comprises the following combination of mutations relative to SEQ ID NO:1, where each mutation of a combination is separated by a "_" and each combination of mutations is between parentheses:
(A106V_D108N), (R107C_D108N),
(H8Y_D108N_S127S_D147Y_Q154H),
(H8Y_R24W_D108N_N127S_D147Y_E155V),
(D108N_D147Y_E155V), (H8Y_D108N_S127S),
(H8Y_D108N_N127S_D147Y_Q154H),
(A106V_D108N_D147Y_E155V),
(D108Q_D147Y_E155V), (D108M_D147Y_E155V),
(D108L_D147Y_E155V), (D108K_D147Y_E155V),
(D108I_D147Y_E155V), (D108F_D147Y_E155V),
(A106V_D108N_D147Y),
(A106V_D108M_D147Y_E155V),
(E59A_A106V_D108N_D147Y_E155V), (E59A cat dead_A106V_D108N_D147Y_E155V),
(L84F_A106V_D108N_H123Y_D147Y_E155V_I156Y),
(L84F_A106V_D108N_H123Y_D147Y_E155V_I156F),
(D103A_D014N), (G22P_D103A_D104N),
(G22P_D103A_D104N_S138A),
(D103A_D104N_S138A),
(R26G_L84F_A106V_R107H_D108N_H123Y_A142N_A143D_D147Y_E155V_I156F),
(E25G_R26G_L84F_A106V_R107H_D108N_H123Y_A142N_A143D_D147Y_E155V_I156F),
(E25D_R26G_L84F_A106V_R107K_D108N_H123Y_A142N_A143G_D147Y_E155V_I156F),
(R26Q_L84F_A106V_D108N_H123Y_A142N_D147Y_E155V_I156F),
(E25M_R26G_L84F_A106V_R107P_D108N_H123Y_A142N_A143D_D147Y_E155V_I156F),
(R26C_L84F_A106V_R107H_D108N_H123Y_A142N_D147Y_E155V_I156F),
(L84F_A106V_D108N_H123Y_A142N_A143L_D147Y_E155V_I156F),
(R26G_L84F_A106V_D108N_H123Y_A142N_D147Y_E155V_I156F),
(E25A_R26G_L84F_A106V_R107N_D108N_H123Y_A142N_A143E_D147Y_E155V_I156F),
(R26G_L84F_A106V_R107H_D108N_H123Y_A142N_A143D_D147Y_E155V_I156F),
(A106V_D108N_A142N_D147Y_E155V),
(R26G_A106V_D108N_A142N_D147Y_E155V),
(E25D_R26G_A106V_R107K_D108N_A142N_A143G_D147Y_E155V),
(R26G_A106V_D108N_R107H_A142N_A143D_D147Y_E155V),
(E25D_R26G_A106V_D108N_A142N_D147Y_E155V),
(A106V_R107K_D108N_A142N_D147Y_E155V),
(A106V_D108N_A142N_A143G_D147Y_E155V),
(A106V_D108N_A142N_A143L_D147Y_E155V),
(H36L_R51L_L84F_A106V_D108N_H123Y_S146C_D147Y_E155V_I156F_K157N),
(N37T_P48T_M70L_L84F_A106V_D108N_H123Y_D147Y_I49V_E155V_I156F),
(N37S_L84F_A106V_D108N_H123Y_D147Y_E155V_I156F_K161T),
(H36L_L84F_A106V_D108N_H123Y_D147Y_Q154H_E155V_I156F),
(N72S_L84F_A106V_D108N_H123Y_S146R_D147Y_E155V_I156F),
(H36L_P48L_L84F_A106V_D108N_H123Y_E134G_D147Y_E155V_I156F),
(H36L_L84F_A106V_D108N_H123Y_D147Y_E155V_I156F_K157N),
(H36L_L84F_A106V_D108N_H123Y_S146C_D147Y_E155V_I156F),
(L84F_A106V_D108N_H123Y_S146R_D147Y_E155V_I156F_K161T),
(N37S_R51H_D77G_L84F_A106V_D108N_H123Y_D147Y_E155V_I156F),
(R51L_L84F_A106V_D108N_H123Y_D147Y_E155V_I156F_K157N),
(D24G_Q71R_L84F_H96L_A106V_D108N_H123Y_D147Y_E155V_I156F_K160E),
(H36L_G67V_L84F_A106V_D108N_H123Y_S146T_D147Y_E155V_I156F),
(Q71L_L84F_A106V_D108N_H123Y_L137M_A143E_D147Y_E155V_I156F),
(E25G_L84F_A106V_D108N_H123Y_D147Y_E155V_I156F_Q159L),
(L84F_A91T_F104I_A106V_D108N_H123Y_D147Y_E155V_I156F),
(N72D_L84F_A106V_D108N_H123Y_G125A_D147Y_E155V_I156F),
(P48S_L84F_S97C_A106V_D108N_H123Y_D147Y_E155V_I156F),
(W23G_L84F_A106V_D108N_H123Y_D147Y_I156F),
(D24G_P48L_Q71R_L84F_A106V_D108N_H123Y_D147Y_E155V_I156F_Q159L),
(L84F_A106V_D108N_H123Y_A142N_D147Y_E155V_I156F),
(H36L_R51L_L84F_A106V_D108N_H123Y_A142N_S146C_D147Y_E155V_I156F_K157N),
(N37S_L84F_A106V_D108N_H123Y_A142N_D147Y_E155V_I156F_K161T),
(L84F_A106V_D108N_D147Y_E155V_I156F),
(R51L_L84F_A106V_D108N_H123Y_S146C_D147Y_E155V_I156F_K157N_K161T),
(L84F_A106V_D108N_H123Y_S146C_D147Y_E155V_I156F_K161T),
(L84F_A106V_D108N_H123Y_S146C_D147Y_E155V_I156F_K157N_K160E_K161T),
(L84F_A106V_D108N_H123Y_S146C_D147Y_E155V_I156F_K157N_K160E), (R74Q L84F_A106V_D108N_H123Y_D147Y_E155V_I156F),
(R74A_L84F_A106V_D108N_H123Y_D147Y_E155V_I156F),
(L84F_A106V_D108N_H123Y_D147Y_E155V_I156F),
(R74Q_L84F_A106V_D108N_H123Y_D147Y_E155V_I156F),
(L84F_R98Q_A106V_D108N_H123Y_D147Y_E155V_I156F),
(L84F_A106V_D108N_H123Y_R129Q_D147Y_E155V_I156F),
(P48S_L84F_A106V_D108N_H123Y_A142N_D147Y_E155V_I156F), (P48S_A142N),
(P48T_I49V_L84F_A106V_D108N_H123Y_A142N_D147Y_E155V_I156F_L157N), (P48T_I49V_A142N),
(H36L_P48S_R51L_L84F_A106V_D108N_H123Y_

S146C_D147Y_E155V_I156F_K157N),
(H36L_P48S_R51L_L84F_A106V_D108N_H123Y_
S146C_A142N_D147Y_E155V_I156F_K157N),
(H36L_P48T_I49V_R51L_L84F_A106V_D108N_
H123Y_S146C_D147Y_E155V_I156F_K157N),
(H36L_P48T_I49V_R51L_L84F_A106V_D108N_
H123Y_A142N_S146C_D147Y_E155V_I156F_K157N),
(H36L_P48A_R51L_L84F_A106V_D108N_H123Y_
S146C_D147Y_E155V_I156F_K157N),
(H36L_P48A_R51L_L84F_A106V_D108N_H123Y_
A142N_S146C_D147Y_E155V_I156F_K157N),
(H36L_P48A_R51L_L84F_A106V_D108N_H123Y_
S146C_A142N_D147Y_E155V_I156F_K157N),
(W23L_H36L_P48A_R51L_L84F_A106V_D108N_
H123Y_S146C_D147Y_E155V_I156F_K157N),
(W23R_H36L_P48A_R51L_L84F_A106V_D108N_
H123Y_S146C_D147Y_E155V_I156F_K157N),
(W23L_H36L_P48A_R51L_L84F_A106V_D108N_
H123Y_S146R_D147Y_E155V_I156F_K161T),
(H36L_P48A_R51L_L84F_A106V_D108N_H123Y_
S146C_D147Y_R152H_E155V_I156F_K157N),
(H36L_P48A_R51L_L84F_A106V_D108N_H123Y_
S146C_D147Y_R152P_E155V_I156F_K157N),
(W23L_H36L_P48A_R51L_L84F_A106V_D108N_
H123Y_S146C_D147Y_R152P_E155V_I156F_K157N),
(W23L_H36L_P48A_R51L_L84F_A106V_D108N_
H123Y_A142A_S146C_D147Y_E155 V_I156F_K157N),
(W23L_H36L_P48A_R51L_L84F_A106V_D108N_
H123Y_A142A_S146C_D147Y_R152P_E155V_I156F_
K157N),
(W23L_H36L_P48A_R51L_L84F_A106V_D108N_
H123Y_S146R_D147Y_E155V_I156F_K161T),
(W23R_H36L_P48A_R51L_L84F_A106V_D108N_
H123Y_S146C_D147Y_R152P_E155V_I156F_K157N),
(H36L_P48A_R51L_L84F_A106V_D108N_H123Y_
A142N_S146C_D147Y_R152P_E155 V_I156F_K157N).

In some embodiments, the adenosine deaminase comprises an amino acid sequence that is at least 60%, 65%, 70%, 75%, 80%, 85%, 90%, 95, 98%, 99%, or 99.5% identical to any one of SEQ ID NOs: 1, 64-84, 420-437, 672-684, or any of the adenosine deaminases provided herein. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more mutations compared to any one of the amino acid sequences set forth in SEQ ID NOs: 1, 64-84, 420-437, 672-684, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 166, identical contiguous amino acid residues as compared to any one of the amino acid sequences set forth in SEQ ID NOs: 1, 64-84, 420-437, 672-684, or any of the adenosine deaminases provided herein. In some embodiments, the adenosine deaminase comprises the amino acid sequence of any one of SEQ ID NOs: 1, 64-84, 420-437, 672-684, or any of the adenosine deaminases provided herein. In some embodiments, the adenosine deaminase consists of the amino acid sequence of any one of SEQ ID NOs: 1, 64-84, 420-437, 672-684, or any of the adenosine deaminases provided herein. The ecTadA sequences provided below are from ecTadA (SEQ ID NO: 1), absent the N-terminal methionine (M). The saTadA sequences provided below are from saTadA (SEQ DI NO: 8), absent the N-terminal methionine (M). For clarity, the amino acid numbering scheme used to identify the various amino acid mutations is derived from ecTadA (SEQ ID NO: 1) for *E. coli* TadA and saTadA (SEQ ID NO: 8) for *S. aureus* TadA. Amino acid mutations, relative to SEQ ID NO: 1 (ecTadA) or SEQ DI NO: 8 (saTadA), are indicated by underlining.

```
ecTadA
                                               (SEQ ID NO: 64)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARDAKTG

AAGSLMDVLHHPGMNHRVEITEGILADECAALLSDFFRMRRQEIKAQKKAQSSTD ecTadA (D108N)
                                               (SEQ ID NO: 65)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARNAKTG

AAGSLMDVLHHPGMNHRVEITEGILADECAALLSDFFRMRRQEIKAQKKAQSSTD ecTadA (D108G)
                                               (SEQ ID NO: 66)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARGAKTG

AAGSLMDVLHHPGMNHRVEITEGILADECAALLSDFFRMRRQEIKAQKKAQSSTD ecTadA (D108V)
                                               (SEQ ID NO: 67)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARVAKTG

AAGSLMDVLHHPGMNHRVEITEGILADECAALLSDFFRMRRQEIKAQKKAQSSTD ecTadA (H8Y, D108N, and N127S)
```

-continued ecTadA (H8Y, D108N, N127S, and E155D) but SEQ ID NO: 68 shown above
(SEQ ID NO: 68)
SEVEFSYEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARNAKTG

AAGSLMDVLHHPGMSHRVEITEGILADECAALLSDFFRMRRQEIKAQKKAQSSTD ecTadA (H8Y, D108N, N127S, and E155D)
(SEQ ID NO: 69)
SEVEFSYEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARNAKTG

AAGSLMDVLHHPGMSHRVEITEGILADECAALLSDFFRMRRQDIKAQKKAQSSTD ecTadA (H8Y, D108N, N127S, and E155G)
(SEQ ID NO: 70)
SEVEFSYEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARNAKTG

AAGSLMDVLHHPGMSHRVEITEGILADECAALLSDFFRMRRQGIKAQKKAQSSTD ecTadA (H8Y, D108N, N127S, and E155V)
(SEQ ID NO: 71)
SEVEFSYEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARNAKTG

AAGSLMDVLHHPGMSHRVEITEGILADECAALLSDFFRMRRQVIKAQKKAQSSTD ecTadA (A106V, D108N, D147Y, and E155V)
(SEQ ID NO: 72)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGVRNAKTG

AAGSLMDVLHHPGMNHRVEITEGILADECAALLSYFFRMRRQVIKAQKKAQSSTD ecTadA (L84F, A106V, D108N, H123Y, D147Y, E155V,
I156F) - result of evolution #3
(SEQ ID NO: 73)
SEVEFSHEYWMRHALTLAKRAWDEREVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (S2A, I49F, A106V, D108N, D147Y, E155V) - result
of evolution #3
(SEQ ID NO: 74)
AEVEFSHEYWMRHALTLAKRAWDEREVPVGAVLVHNNRVIGEGWNRPFGRHDPTA

HAEIMALRQGGLVMQNYRLIDATLYVTLEPCVMCAGAMIHSRIGRVVFGVRNAKTG

AAGSLMDVLHHPGMNHRVEITEGILADECAALLSYFFRMRRQVIKAQKKAQSSTD ecTadA (H8Y, A106T, D108N, N127S, K160S) - result
of evolution #3
(SEQ ID NO: 75)
SEVEFSYEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGTRNAKTG

AAGSLMDVLHHPGMSHRVEITEGILADECAALLSDFFRMRRQEIKAQSKAQSSTD ecTadA (R26G, L84F, A106V, R107H, D108N, H123Y, A142N,
A143D, D147Y, E155V, I156F) - result of evolution #4
(SEQ ID NO: 76)
SEVEFSHEYWMRHALTLAKRAWDEGEVPVGAVLVHNNRVIGEGWNRPIGRHDPTA

HAEIMALRQGGLVMQNYRLIDATLYVTFEPCVMCAGAMIHSRIGRVVFGVHNAKTG

AAGSLMDVLHYPGMNHRVEITEGILADECNDLLSYFFRMRRQVFKAQKKAQSSTD ecTadA (E25G, R26G, L84F, A106V, R107H, D108N, H123Y,
A142N, A143D, D147Y, E155V, I156F) - result of evolution #4
(SEQ ID NO: 77)
SEVEFSHEYWMRHALTLAKRAWDGGEVPVGAVLVHNNRVIGEGWNRPIGRHDPTA

HAEIMALRQGGLVMQNYRLIDATLYVTFEPCVMCAGAMIHSRIGRVVFGVHNAKTG

-continued

AAGSLMDVLHYPGMNHRVEITEGILADECNDLLSYFFRMRRQVFKAQKKAQSSTD ecTadA (E25D, R26G, L84F, A106V, R107K, D108N, H123Y,
A142N, A143G, D147Y, E155V, I156F) - result of evolution #4
(SEQ ID NO: 78)
SEVEFSHEYWMRHALTLAKRAWDDGEVPVGAVLVHNNRVIGEGWNRPIGRHDPTA

HAEIMALRQGGLVMQNYRLIDATLYVTFEPCVMCAGAMIHSRIGRVVFGVKNAKTG

AAGSLMDVLHYPGMNHRVEITEGILADECNGLLSYFFRMRRQVFKAQKKAQSSTD ecTadA (R26Q, L84F, A106V, D108N, H123Y, A142N, D147Y,
E155V, I156F) - result of evolution #4
(SEQ ID NO: 79)
SEVEFSHEYWMRHALTLAKRAWDEQEVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECNALLSYFFRMRRQVFKAQKKAQSSTD ecTadA (E25M, R26G, L84F, A106V, R107P, D108N, H123Y,
A142N, A143D, D147Y, E155V, I156F) - result of evolution #4
(SEQ ID NO: 80)
SEVEFSHEYWMRHALTLAKRAWDMGEVPVGAVLVHNNRVIGEGWNRPIGRHDPTA

HAEIMALRQGGLVMQNYRLIDATLYVTFEPCVMCAGAMIHSRIGRVVFGVPNAKTG

AAGSLMDVLHYPGMNHRVEITEGILADECNDLLSYFFRMRRQVFKAQKKAQSSTD ecTadA (R26C, L84F, A106V, R107H, D108N, H123Y, A142N,
D147Y, E155V, I156F) - result of evolution #4
(SEQ ID NO: 81)
SEVEFSHEYWMRHALTLAKRAWDECEVPVGAVLVHNNRVIGEGWNRPIGRHDPTA

HAEIMALRQGGLVMQNYRLIDATLYVTFEPCVMCAGAMIHSRIGRVVFGVHNAKTG

AAGSLMDVLHYPGMNHRVEITEGILADECNALLSYFFRMRRQVFKAQKKAQSSTD ecTadA (L84F, A106V , D108N, H123Y, A142N, A143L, D147Y,
E155V, I156F) - result of evolution #4
(SEQ ID NO: 82)
SEVEFSHEYWMRHALTLAKRAWDEREVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECNLLLSYFFRMRRQVFKAQKKAQSSTD ecTadA (R26G, L84F, A106V, D108N, H123Y, A142N, D147Y,
E155V, I156F) - result of evolution #4
(SEQ ID NO: 83)
SEVEFSHEYWMRHALTLAKRAWDEGEVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECNALLSYFFRMRRQVFKAQKKAQSSTD ecTadA (E25A, R26G, L84F, A106V, R107N, D108N, H123Y,
A142N, A143E, D147Y, E155V, I156F) - result of evolution #4
(SEQ ID NO: 420)
SEVEFSHEYWMRHALTLAKRAWDAGEVPVGAVLVHNNRVIGEGWNRPIGRHDPTA

HAEIMALRQGGLVMQNYRLIDATLYVTFEPCVMCAGAMIHSRIGRVVFGVNNAKTG

AAGSLMDVLHYPGMNHRVEITEGILADECNELLSYFFRMRRQVFKAQKKAQSSTD ecTadA (L84F, A106V, D108N, H123Y, D147Y, E155V, I156F) -
mutations from evolution #'s 1-3
(SEQ ID NO: 421)
SEVEFSHEYWMRHALTLAKRAWDEREVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (N37T, P48T, L84F, A106V, D108N, H123Y, D147Y,
E155V, I156F) - mutations from evolution # 5-1
(SEQ ID NO: 422)
SEVEFSHEYWMRHALTLAKRAWDEREVPVGAVLVHTNRVIGEGWNRTIGRHDPTA

HAEIMALRQGGLVMQNYRLIDATLYVTFEPCVMCAGAMIHSRIGRVVFGVRNAKTG

-continued ecTadA (N37S, L84F, A106V, D108N, H123Y, D147Y, E155V,
I156F) - mutations from evolution # 5-2
(SEQ ID NO: 423)
SEVEFSHEYWMRHALTLAKRAWDEREVPVGAVLVHSNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (H36L, L84F, A106V, D108N, H123Y, D147Y, E155V,
I156F) - mutations from evolution # 5-3
(SEQ ID NO: 424)
SEVEFSHEYWMRHALTLAKRAWDEREVPVGAVLVLNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (L84F, A106V, D108N, H123Y, S146R, D147Y, E155V,
I156F) - mutations from evolution # 5-4
(SEQ ID NO: 425)
SEVEFSHEYWMRHALTLAKRAWDEREVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLRYFFRMRRQVFKAQKKAQSSTD ecTadA (H36L, P48L, L84F, A106V, D108N, H123Y, D147Y,
E155V, I156F) - mutations from evolution # 5-5
(SEQ ID NO: 426)
SEVEFSHEYWMRHALTLAKRAWDEREVPVGAVLVLNNRVIGEGWNRLIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (H36L, L84F, A106V, D108N, H123Y, D147Y, E155V,
K57N, I156F) - mutations from evolution # 5-6
(SEQ ID NO: 427)
SEVEFSHEYWMRHALTLAKRAWDEREVPVGAVLVLNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFNAQKKAQSSTD ecTadA (H36L, L84F, A106V, D108N, H123Y, S146C, D147Y,
E155V, I156F) - mutations from evolution # 5-7
(SEQ ID NO: 428)
SEVEFSHEYWMRHALTLAKRAWDEREVPVGAVLVLNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLCYFFRMRRQVFKAQKKAQSSTD ecTadA (L84F, A106V, D108N, H123Y, S146R, D147Y, E155V,
I156F) - mutations from evolution # 5-8
(SEQ ID NO: 429)
SEVEFSHEYWMRHALTLAKRAWDEREVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLRYFFRMRRQVFKAQKKAQSSTD ecTadA (N37S, R51H, L84F, A106V, D108N, H123Y, D147Y,
E155V, I156F) - mutations from evolution # 5-9
(SEQ ID NO: 430)
SEVEFSHEYWMRHALTLAKRAWDEREVPVGAVLVHSNRVIGEGWNRPIGHHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (R51L, L84F, A106V, D108N, H123Y, D147Y, E155V,
I156F, K157N) - mutations from evolution # 5-10
(SEQ ID NO: 431)
SEVEFSHEYWMRHALTLAKRAWDEREVPVGAVLVHNNRVIGEGWNRPIGLHDPTA

HAEIMALRQGGLVMQNYRLIDATLYVTFEPCVMCAGAMIHSRIGRVVFGVRNAKTG

```
AAGSLMDVLHYPGMNHRVEITEGILADECAALLSYFFRMRRQVFNAQKKAQSSTD ecTadA (R51H, L84F, A106V, D108N, H123Y, D147Y, E155V,
I156F, K157N) - mutations from evolution # 5-11
                                        (SEQ ID NO: 432)
SEVEFSHEYWMRHALTLAKRAWDEREVPVGAVLVHNNRVIGEGWNRPIGHHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFNAQKKAQSSTD saTadA (wt) - as used in pNMG-345:
                                        (SEQ ID NO: 8)
MGSHMTNDIYFMTLAIEEAKKAAQLGEVPIGAIITKDDEVIARAHNLRETLQQPTAH

AEHIAIERAAKVLGSWRLEGCTLYVTLEPCVMCAGTIVMSRIPRVVYGADDPKGGCS

GSLMNLLQQSNFNHRAIVDKGVLKEACSTLLTTFFKNLRANKKSTN saTadA (D108N) - as used in pNMG-346:
                                        (SEQ ID NO: 433)
GSHMTNDIYFMTLAIEEAKKAAQLGEVPIGAIITKDDEVIARAHNLRETLQQPTAHAE

HIAIERAAKVLGSWRLEGCTLYVTLEPCVMCAGTIVMSRIPRVVYGADNPKGGCSGS

LMNLLQQSNFNHRAIVDKGVLKEACSTLLTTFFKNLRANKKSTN saTadA (D107A_D108N) - as used in pNMG-347:
                                        (SEQ ID NO: 434)
GSHMTNDIYFMTLAIEEAKKAAQLGEVPIGAIITKDDEVIARAHNLRETLQQPTAHAE

HIAIERAAKVLGSWRLEGCTLYVTLEPCVMCAGTIVMSRIPRVVYGAANPKGGCSGS

LMNLLQQSNFNHRAIVDKGVLKEACSTLLTTFFKNLRANKKSTN saTadA (G26P_D107A_D108N) - as used in pNMG-348:
                                        (SEQ ID NO: 435)
GSHMTNDIYFMTLAIEEAKKAAQLPEVPIGAIITKDDEVIARAHNLRETLQQPTAHAE

HIAIERAAKVLGSWRLEGCTLYVTLEPCVMCAGTIVMSRIPRVVYGAANPKGGCSGS

LMNLLQQSNFNHRAIVDKGVLKEACSTLLTTFFKNLRANKKSTN saTadA (G26P_D107A_D108N_S142A) - as used in pNMG-349:
                                        (SEQ ID NO: 436)
GSHMTNDIYFMTLAIEEAKKAAQLPEVPIGAIITKDDEVIARAHNLRETLQQPTAHAE

HIAIERAAKVLGSWRLEGCTLYVTLEPCVMCAGTIVMSRIPRVVYGAANPKGGCSGS

LMNLLQQSNFNHRAIVDKGVLKEACATLLTTFFKNLRANKKSTN saTadA (D107A_D108N_S142A) - as used in pNMG-350:
                                        (SEQ ID NO: 437)
GSHMTNDIYFMTLAIEEAKKAAQLGEVPIGAIITKDDEVIARAHNLRETLQQPTAHAE

HIAIERAAKVLGSWRLEGCTLYVTLEPCVMCAGTIVMSRIPRVVYGAANPKGGCSGS

LMNLLQQSNFNHRAIVDKGVLKEACATLLTTFFKNLRANKKSTN ecTadA (P48S) - mutation from evolution #6
                                        (SEQ ID NO: 672)
SEVEFSHEYWMRHALTLAKRAWDEREVPVGAVLVHNNRVIGEGWNRSIGRHDPTA

HAEIMALRQGGLVMQNYRLIDATLYVTLEPCVMCAGAMIHSRIGRVVFGARDAKTG

AAGSLMDVLHHPGMNHRVEITEGILADECAALLSDFFRMRRQEIKAQKKAQSSTD ecTadA (P48T) - mutation from evolution #6
                                        (SEQ ID NO: 673)
SEVEFSHEYWMRHALTLAKRAWDEREVPVGAVLVHNNRVIGEGWNRTIGRHDPTA

HAEIMALRQGGLVMQNYRLIDATLYVTLEPCVMCAGAMIHSRIGRVVFGARDAKTG

AAGSLMDVLHHPGMNHRVEITEGILADECAALLSDFFRMRRQEIKAQKKAQSSTD ecTadA (P48A) - mutation from evolution #6
                                        (SEQ ID NO: 674)
SEVEFSHEYWMRHALTLAKRAWDEREVPVGAVLVHNNRVIGEGWNRAIGRHDPTA

HAEIMALRQGGLVMQNYRLIDATLYVTLEPCVMCAGAMIHSRIGRVVFGARDAKTG
```

-continued

AAGSLMDVLHHPGMNHRVEITEGILADECAALLSDFFRMRRQEIKAQKKAQSSTD ecTadA (A142N) - mutation from evolution #6
(SEQ ID NO: 675)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARDAKTG

AAGSLMDVLHHPGMNHRVEITEGILADECNALLSDFFRMRRQEIKAQKKAQSSTD ecTadA (W23R) - mutation from evolution #7
(SEQ ID NO: 676)
SEVEFSHEYWMRHALTLAKRARDEREVPVGAVLVHNNRVIGEGWNRPIGRHDPTA

HAEIMALRQGGLVMQNYRLIDATLYVTLEPCVMCAGAMIHSRIGRVVFGARDAKTG

AAGSLMDVLHHPGMNHRVEITEGILADECAALLSDFFRMRRQEIKAQKKAQSSTD ecTadA (W23L) - mutation from evolution #7
(SEQ ID NO: 677)
SEVEFSHEYWMRHALTLAKRALDEREVPVGAVLVHNNRVIGEGWNRPIGRHDPTAH

AEIMALRQGGLVMQNYRLIDATLYVTLEPCVMCAGAMIHSRIGRVVFGARDAKTGA

AGSLMDVLHHPGMNHRVEITEGILADECAALLSDFFRMRRQEIKAQKKAQSSTD ecTadA (R152P) - mutation from evolution #7
(SEQ ID NO: 678)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARDAKTG

AAGSLMDVLHHPGMNHRVEITEGILADECAALLSDFFRMPRQEIKAQKKAQSSTD ecTadA (R152H) - mutation from evolution #7
(SEQ ID NO: 679)
SEVEFSHEYWMRHALTLAKRAWDEREVPVGAVLVHNNRVIGEGWNRPIGRHDPTA

HAEIMALRQGGLVMQNYRLIDATLYVTLEPCVMCAGAMIHSRIGRVVFGARDAKTG

AAGSLMDVLHHPGMNHRVEITEGILADECAALLSDFFRMHRQEIKAQKKAQSSTD ecTadA (L84F, A106V, D108N, H123Y, D147Y, E155V, I156F) -
mutations from pNMG 371
(SEQ ID NO: 680)
SEVEFSHEYWMRHALTLAKRAWDEREVPVGAVLVHNNRVIGEGWNRPIGRHDPTA

HAEIMALRQGGLVMQNYRLIDATLYVTFEPCVMCAGAMIHSRIGRVVFGVRNAKTG

AAGSLMDVLHYPGMNHRVEITEGILADECAALLSYFFRMRRQVFKAQKKAQSSTD ecTadA (H36L, R51L, L84F, A106V, D108N, H123Y, S146C,
D147Y, E155V, I156F, K157N) - mutations from pNMG 477
(SEQ ID NO: 681)
SEVEFSHEYWMRHALTLAKRAWDEREVPVGAVLVLNNRVIGEGWNRPIGLHDPTA

HAEIMALRQGGLVMQNYRLIDATLYVTFEPCVMCAGAMIHSRIGRVVFGVRNAKTG

AAGSLMDVLHYPGMNHRVEITEGILADECAALLCYFFRMRRQVFNAQKKAQSSTD ecTadA (H36L, P48S, R51L, L84F, A106V, D108N, H123Y, S146C,
D147Y, E155V, I156F, K157N) - mutations from pNMG 576
(SEQ ID NO: 682)
SEVEFSHEYWMRHALTLAKRAWDEREVPVGAVLVLNNRVIGEGWNRSIGLHDPTA

HAEIMALRQGGLVMQNYRLIDATLYVTFEPCVMCAGAMIHSRIGRVVFGVRNAKTG

AAGSLMDVLHYPGMNHRVEITEGILADECAALLCYFFRMRRQVFNAQKKAQSSTD ecTadA (H36L, P48A, R51L, L84F, A106V, D108N, H123Y, S146C,
D147Y, E155V, I156F, K157N) - mutations from pNMG 586
(SEQ ID NO: 683)
SEVEFSHEYWMRHALTLAKRAWDEREVPVGAVLVLNNRVIGEGWNRAIGLHDPTA

HAEIMALRQGGLVMQNYRLIDATLYVTFEPCVMCAGAMIHSRIGRVVFGVRNAKTG

AAGSLMDVLHYPGMNHRVEITEGILADECAALLCYFFRMRRQVFNAQKKAQSSTD

```
ecTadA (W23L, H36L, P48A, R51L, L84F, A106V, D108N, H123Y,
S146C, D147Y, R152P, E155V, I156F, K157N) - mutations from
pNMG 616
                                              (SEQ ID NO: 684)
SEVEFSHEYWMRHALTLAKRALDEREVPVGAVLVLNNRVIGEGWNRAIGLHDPTAH

AEIMALRQGGLVMQNYRLIDATLYVTFEPCVMCAGAMIHSRIGRVVFGVRNAKTGA

AGSLMDVLHYPGMNHRVEITEGILADECAALLCYFFRMPRQVFNAQKKAQSSTD
```

Cas9 Domains of Nucleobase Editors

In some aspects, a nucleic acid programmable DNA binding protein (napDNAbp) is a Cas9 domain. Non-limiting, exemplary Cas9 domains are provided herein. The Cas9 domain may be a nuclease active Cas9 domain, a nuclease inactive Cas9 domain, or a Cas9 nickase. In some embodiments, the Cas9 domain is a nuclease active domain. For example, the Cas9 domain may be a Cas9 domain that cuts both strands of a duplexed nucleic acid (e.g., both strands of a duplexed DNA molecule). In some embodiments, the Cas9 domain comprises any one of the amino acid sequences as set forth in SEQ ID NOs: 108-357. In some embodiments the Cas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in SEQ ID NOs: 108-357. In some embodiments, the Cas9 domain comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a nuclease-inactive Cas9 domain (dCas9). For example, the dCas9 domain may bind to a duplexed nucleic acid molecule (e.g., via a gRNA molecule) without cleaving either strand of the duplexed nucleic acid molecule. In some embodiments, the nuclease-inactive dCas9 domain comprises a D10X mutation and a H840X mutation of the amino acid sequence set forth in SEQ ID NO: 52, or a corresponding mutation in any of the amino acid sequences provided in SEQ ID NOs: 108-357, wherein X is any amino acid change. In some embodiments, the nuclease-inactive dCas9 domain comprises a D10A mutation and a H840A mutation of the amino acid sequence set forth in SEQ ID NO: 52, or a corresponding mutation in any of the amino acid sequences provided in SEQ ID NOs: 108-357. As one example, a nuclease-inactive Cas9 domain comprises the amino acid sequence set forth in SEQ ID NO: 54 (Cloning vector pPlatTET-gRNA2, Accession No. BAV54124).

```
MDKKYSIGLAIGTNSVGWAVITDEYKVPSKKFKVLGNTDRHSIKKNLIGA

LLFDSGETAEATRLKRTARRRYTRRKNRICYLQEIFSNEMAKVDDSFFHR

LEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTP

NFKSNFDLAEDAKLQLSKDTYDDDLDNLLAQIGDQYADLFLAAKNLSDAI

LLSDILRVNTEITKAPLSASMIKRYDEHHQDLTLLKALVRQQLPEKYKEI

FFDQSKNGYAGYIDGGASQEEFYKFIKPILEKMDGTEELLVKLNREDLLR

KQRTFDNGSIPHQIHLGELHAILRRQEDFYPFLKDNREKIEKILTFRIPY

YVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVD

LLFKTNRKVTVKQLKEDYFKKIECFDSVEISGVEDRFNASLGTYHDLLKI

IKDKDFLDNEENEDILEDIVLTLTLFEDREMIEERLKTYAHLFDDKVMKQ

LKRRRYTGWGRLSRKLINGIRDKQSGKTILDFLKSDGFANRNFMQLIHDD

SLTFKEDIQKAQVSGQGDSLHEHIANLAGSPAIKKGILQTVKVVDELVKV

MGRHKPENIVIEMARENQTTQKGQKNSRERMKRIEEGIKELGSQILKEHP

VENTQLQNEKLYLYYLQNGRDMYVDQELDINRLSDYDVDAIVPQSFLKDD

SIDNKVLTRSDKNRGKSDNVPSEEVVKKMKNYWRQLLNAKLITQRKFDNL

TKAERGGLSELDKAGFIKRQLVETRQITKHVAQILDSRMNTKYDENDKLI

REVKVITLKSKLVSDFRKDFQFYKVREINNYHHAHDAYLNAVVGTALIKK

YPKLESEFVYGDYKVYDVRKMIAKSEQEIGKATAKYFFYSNIMNFFKTEI

TLANGEIRKRPLIETNGETGEIVWDKGRDFATVRKVLSMPQVNIVKKTEV

QTGGFSKESILPKRNSDKLIARKKDWDPKKYGGFDSPTVAYSVLVVAKVE

KGKSKKLKSVKELLGITIMERSSFEKNPIDFLEAKGYKEVKKDLIIKLPK

YSLFELENGRKRMLASAGELQKGNELALPSKYVNFLYLASHYEKLKGSPE

DNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQ

SITGLYETRIDLSQLGGD
(SEQ ID NO: 54; see, e.g., Qi et al., "Repurposing
CRISPR as an RNA-guided platform for sequence-
specific control of gene expression." Cell. 2013;
152(5): 1173-83, the entire contents of which
are incorporated herein by reference).
```

Additional suitable nuclease-inactive dCas9 domains will be apparent to those of skill in the art based on this disclosure and knowledge in the field, and are within the scope of this disclosure. Such additional exemplary suitable nuclease-inactive Cas9 domains include, but are not limited to, D10A/H840A, D10A/D839A/H840A, and D10A/D839A/H840A/N863A mutant domains (See, e.g., Prashant et al., CAS9 transcriptional activators for target specificity screening and paired nickases for cooperative genome engineering. *Nature Biotechnology.* 2013; 31(9): 833-838, the entire contents of which are incorporated herein by reference). In some embodiments the dCas9 domain comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the dCas9 domains provided herein. In some embodiments, the Cas9 domain comprises an amino acid sequences that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 108-357. In some embodiments, the Cas9 domain comprises an amino acid sequence that has at least 10, at least 15, at least 20, at least 30, at least 40, at least 50, at least 60, at least 70, at least 80, at least 90, at least 100, at least 150, at least 200, at least 250, at least 300, at least 350, at least 400, at least 500, at least 600, at least 700, at least 800, at least 900, at least 1000, at least 1100, or at least 1200 identical contiguous amino acid residues as compared to any one of the amino acid sequences set forth in SEQ ID NOs: 108-357.

In some embodiments, the Cas9 domain is a Cas9 nickase. The Cas9 nickase may be a Cas9 protein that is capable of cleaving only one strand of a duplexed nucleic acid molecule (e.g., a duplexed DNA molecule). In some embodiments the Cas9 nickase cleaves the target strand of a duplexed nucleic acid molecule, meaning that the Cas9 nickase cleaves the strand that is base paired to (complementary to) a gRNA (e.g., an sgRNA) that is bound to the Cas9. In some embodiments, a Cas9 nickase comprises a D10A mutation and has a histidine at position 840 of SEQ ID NO: 52, or a mutation in any of SEQ ID NOs: 108-357. As one example, a Cas9 nickase may comprise the amino acid sequence as set forth in SEQ ID NO: 35. In some embodiments, the Cas9 nickase cleaves the non-target, non-base-edited strand of a duplexed nucleic acid molecule, meaning that the Cas9 nickase cleaves the strand that is not base paired to a gRNA (e.g., an sgRNA) that is bound to the Cas9. In some embodiments, a Cas9 nickase comprises an H840A mutation and has an aspartic acid residue at position 10 of SEQ ID NO: 52, or a corresponding mutation in any of SEQ ID NOs: 108-357. In some embodiments the Cas9 nickase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the Cas9 nickases provided herein. Additional suitable Cas9 nickases will be apparent to those of skill in the art based on this disclosure and knowledge in the field, and are within the scope of this disclosure.

Cas9 Domains with Reduced PAM Exclusivity

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region, where the "N" in "NGG" is adenine (A), thymine (T), guanine (G), or cytosine (C), and the G is guanine. This may limit the ability to edit desired bases within a genome. In some embodiments, the base editing fusion proteins provided herein need to be positioned at a precise location, for example, where a target base is within a 4 base region (e.g., a "deamination window"), which is approximately 15 bases upstream of the PAM. See Komor, A. C., et al., "Programmable editing of a target base in genomic DNA without double-stranded DNA cleavage" Nature 533, 420-424 (2016), the entire contents of which are hereby incorporated by reference. In some embodiments, the deamination window is within a 2, 3, 4, 5, 6, 7, 8, 9, or 10 base region. In some embodiments, the deamination window is 5, 6, 7, 8, 9, 10, 11, 12, 13, 14, 15, 16, 17, 18, 19, 20, 21, 22, 23, 24, or 25 bases upstream of the PAM. Accordingly, in some embodiments, any of the fusion proteins provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" *Nature* 523, 481-485 (2015); and Kleinstiver, B. P., et al., "Broadening the targeting range of *Staphylococcus aureus* CRISPR-Cas9 by modifying PAM recognition" *Nature Biotechnology* 33, 1293-1298 (2015); the entire contents of each are hereby incorporated by reference.

In some embodiments, the Cas9 domain is a Cas9 domain from *Staphylococcus aureus* (SaCas9). In some embodiments, the SaCas9 domain is a nuclease active SaCas9, a nuclease inactive SaCas9 (SaCas9d), or a SaCas9 nickase (SaCas9n). In some embodiments, the SaCas9 comprises the amino acid sequence SEQ ID NO: 55. In some embodiments, the SaCas9 comprises a N579X mutation of SEQ ID NO: 55, or a corresponding mutation in any of the amino acid sequences provided in SEQ ID NOs: 108-357, wherein X is any amino acid except for N. In some embodiments, the SaCas9 comprises a N579A mutation of SEQ ID NO: 55, or a corresponding mutation in any of the amino acid sequences provided in SEQ ID NOs: 108-357.

In some embodiments, the SaCas9 domain, the SaCas9d domain, or the SaCas9n domain can bind to a nucleic acid sequence having a non-canonical PAM. In some embodiments, the SaCas9 domain, the SaCas9d domain, or the SaCas9n domain can bind to a nucleic acid sequence having a NNGRRT PAM sequence, where N=A, T, C, or G, and R=A or G. In some embodiments, the SaCas9 domain comprises one or more of E781X, N967X, and R1014X mutation of SEQ ID NO: 55, or a corresponding mutation in any of the amino acid sequences provided in SEQ ID NOs: 108-357, wherein X is any amino acid. In some embodiments, the SaCas9 domain comprises one or more of a E781K, a N967K, and a R1014H mutation of SEQ ID NO: 55, or one or more corresponding mutation in any of the amino acid sequences provided in SEQ ID NOs: 108-357. In some embodiments, the SaCas9 domain comprises a E781K, a N967K, or a R1014H mutation of SEQ ID NO: 55, or corresponding mutations in any of the amino acid sequences provided in SEQ ID NOs: 108-357.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 55-57. In some embodiments, the Cas9 domain of any of the fusion proteins provided herein comprises the amino acid sequence of any one of SEQ ID NOs: 55-57. In some embodiments, the Cas9 domain of any of the fusion proteins provided herein consists of the amino acid sequence of any one of SEQ ID NOs: 55-57.

Exemplary SaCas9 sequence (SEQ ID NO: 55)
KRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIPKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG Residue N579 of SEQ ID NO: 55, which is underlined and in bold, may be mutated (e.g., to a A579) to yield a SaCas9 nickase.

Exemplary SaCas9n sequence (SEQ ID NO: 56)
KRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIRTTGKENAKYLIEKIKLHDMQEGKCLYSLEAIPLEDLLNNP
FNYEVDHIIPRSVSFDNSFNNKVLVKQEEASKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIPKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFYNNDLIKINGELYRVIGVNNDLLNRIEVNMIDIT
YREYLENMNDKRPPRIIKTIASKTQSIKKYSTDILGNLYEVKSKKHPQII
KKG.

Residue A579 of SEQ ID NO: 56, which can be mutated from N579 of SEQ ID NO: 55 to yield a SaCas9 nickase, is underlined and in bold.

Exemplary SaKKH Cas9

(SEQ ID NO: 57)
KRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVNEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIRTTGKENAKYLIEKIKLHDMQEGKCLYSLEAIPLEDLLNNP
FNYEVDHIIPRSVSFDNSFNNKVLVKQEEASKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIPKEWKKLDKAKKVMENQMFEEKQAESMPEIETEQEY
KEIFITPHQIKHIKDFKDYKYSHRVDKKPNR*K*LINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
RNKVVKLSLKPYRFDVYLDNGVYKFVTVKNLDVIKKENYYEVNSKCYEEA
KKLKKISNQAEFIASFY*K*NDLIKINGELYRVIGVNNDLLNRIEVNMIDIT
YREYLENMNDKRPP*H*IIKTIASKTQSIKKYSTDILGNLYEVKSKKHPQII
KKG.

Residue A579 of SEQ ID NO: 57, which can be mutated from N579 of SEQ ID NO: 55 to yield a SaCas9 nickase, is underlined and in bold. Residues K781, K967, and H1014 of SEQ ID NO: 57, which can be mutated from E781, N967, and R$^{1014}$ of SEQ ID NO: 55 to yield a SaKKH Cas9 are underlined and in italics.

In some embodiments, the Cas9 domain is a Cas9 domain from *Streptococcus pyogenes* (SpCas9). In some embodiments, the SpCas9 domain is a nuclease active SpCas9, a nuclease inactive SpCas9 (SpCas9d), or a SpCas9 nickase (SpCas9n). In some embodiments, the SpCas9 comprises the amino acid sequence SEQ ID NO: 58. In some embodiments, the SpCas9 comprises a D9X mutation of SEQ ID NO: 58, or a corresponding mutation in any of the amino acid sequences provided in SEQ ID NOs: 108-357, wherein X is any amino acid except for D. In some embodiments, the SpCas9 comprises a D9A mutation of SEQ ID NO: 58, or a corresponding mutation in any of the amino acid sequences provided in SEQ ID NOs: 108-357. In some embodiments, the SpCas9 domain, the SpCas9d domain, or the SpCas9n domain can bind to a nucleic acid sequence having a non-canonical PAM. In some embodiments, the SpCas9 domain, the SpCas9d domain, or the SpCas9n domain can bind to a nucleic acid sequence having a NGG, a NGA, or a NGCG PAM sequence. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134E, R1334Q, and T1336R mutation of SEQ ID NO: 58, or a corresponding mutation in any of the amino acid sequences provided in SEQ ID NOs: 108-35. In some embodiments, the SpCas9 domain comprises a D1134E, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a R1334Q, and a T1336R mutation of SEQ ID NO: 58, or corresponding mutations in any of the amino acid sequences provided in SEQ ID NOs: 108-35. In some embodiments, the SpCas9 domain comprises one or more of a D1134X, a G1217X, a R1334X, and a T1336X mutation of SEQ ID NO: 58, or a corresponding mutation in any of the amino acid sequences provided in SEQ ID NOs: 108-35, wherein X is any amino acid. In some embodiments, the SpCas9 domain comprises one or more of a D1134V, a G1217R, a R1334Q, and a T1336R mutation of SEQ ID NO: 58, or a corresponding mutation in any of the amino acid sequences provided in SEQ ID NOs: 108-35. In some embodiments, the SpCas9 domain comprises a D1134V, a G1217R, a R1334Q, and a T1336R mutation of SEQ ID NO: 58, or corresponding mutations in any of the amino acid sequences provided in SEQ ID NOs: 108-35.

In some embodiments, the Cas9 domain of any of the fusion proteins provided herein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of SEQ ID NOs: 58-62. In some embodiments, the Cas9 domain of any of the fusion proteins provided herein comprises the amino acid sequence of any one of SEQ ID NOs: 58-62. In some embodiments, the Cas9 domain of any of the fusion proteins provided herein consists of the amino acid sequence of any one of SEQ ID NOs: 58-62.

Exemplary SpCas9
(SEQ ID NO: 58)
DKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFDSPTVAYSVLVVAKVEK

GKSKKLKSVKELLGITIMERSSFEKNPIDFLEAKGYKEVKKDLIIKLPKY

SLFELENGRKRMLASAGELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKRYTSTKEVLDATLIHQS

ITGLYETRIDLSQLGGD

Exemplary SpCas9n
(SEQ ID NO: 59)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

-continued

LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFDSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKRYTSTKEVLDATLIHQS
ITGLYETRIDLSQLGGD

Exemplary SpEQR Cas9
(SEQ ID NO: 60)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFESPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKQYRSTKEVLDATLIHQS
ITGLYETRIDLSQLGGD Residues E1134, Q1334, and R1336 of SEQ ID NO: 60, which can be mutated from D1134, R1334, and T1336 of SEQ ID NO: 58 to yield a SpEQR Cas9, are underlined and in bold.

Exemplary SpVQR Cas9
(SEQ ID NO: 61)
DKKYSIGLAIGTNSVGWAVITDEYKVPSKKFKVLGNTDRHSIKKNLIGAL
LFDSGETAEATRLKRTARRRYTRRKNRICYLQEIFSNEMAKVDDSFFHRL
EESFLVEEDKKHERHPIFGNIVDEVAYHEKYPTIYHLRKKLVDSTDKADL
RLIYLALAHMIKFRGHFLIEGDLNPDNSDVDKLFIQLVQTYNQLFEENPI
NASGVDAKAILSARLSKSRRLENLIAQLPGEKKNGLFGNLIALSLGLTPN
FKSNFDLAEDAKLQLSKDTYDDDLDNLLAQIGDQYADLFLAAKNLSDAIL
LSDILRVNTEITKAPLSASMIKRYDEHHQDLTLLKALVRQQLPEKYKEIF
FDQSKNGYAGYIDGGASQEEFYKFIKPILEKMDGTEELLVKLNREDLLRK
QRTFDNGSIPHQIHLGELHAILRRQEDFYPFLKDNREKIEKILTFRIPYY
VGPLARGNSRFAWMTRKSEETITPWNFEEVVDKGASAQSFIERMTNFDKN
LPNEKVLPKHSLLYEYFTVYNELTKVKYVTEGMRKPAFLSGEQKKAIVDL
LFKTNRKVTVKQLKEDYFKKIECFDSVEISGVEDRFNASLGTYHDLLKII
KDKDFLDNEENEDILEDIVLTLTLFEDREMIEERLKTYAHLFDDKVMKQL
KRRRYTGWGRLSRKLINGIRDKQSGKTILDFLKSDGFANRNFMQLIHDDS
LTFKEDIQKAQVSGQGDSLHEHIANLAGSPAIKKGILQTVKVVDELVKVM
GRHKPENIVIEMARENQTTQKGQKNSRERMKRIEEGIKELGSQILKEHPV
ENTQLQNEKLYLYYLQNGRDMYVDQELDINRLSDYDVDHIVPQSFLKDDS
IDNKVLTRSDKNRGKSDNVPSEEVVKKMKNYWRQLLNAKLITQRKFDNLT
KAERGGLSELDKAGFIKRQLVETRQITKHVAQILDSRMNTKYDENDKLIR
EVKVITLKSKLVSDFRKDFQFYKVREINNYHHAHDAYLNAVVGTALIKKY
PKLESEFVYGDYKVYDVRKMIAKSEQEIGKATAKYFFYSNIMNFFKTEIT
LANGEIRKRPLIETNGETGEIVWDKGRDFATVRKVLSMPQVNIVKKTEVQ
TGGFSKESILPKRNSDKLIARKKDWDPKKYGGFVSPTVAYSVLVVAKVEK
GKSKKLKSVKELLGITIMERSSFEKNPIDFLEAKGYKEVKKDLIIKLPKY
SLFELENGRKRMLASAGELQKGNELALPSKYVNFLYLASHYEKLKGSPED
NEQKQLFVEQHKHYLDEIIEQISEFSKRVILADANLDKVLSAYNKHRDKP
IREQAENIIHLFTLTNLGAPAAFKYFDTTIDRKQYRSTKEVLDATLIHQS
ITGLYETRIDLSQLGGD Residues V1134, Q1334, and R1336 of SEQ ID NO: 61, which can be mutated from D1134, R1334, and T1336 of SEQ ID NO: 58 to yield a SpVQR Cas9, are underlined and in bold.

Exemplary SpVRER Cas9
(SEQ ID NO: 62)
DKKYSIGLAIGTNSVGWAVITDEYKVPSKKFKVLGNTDRHSIKKNLIGAL

LFDSGETAEATRLKRTARRRYTRRKNRICYLQEIFSNEMAKVDDSFFHRL

EESFLVEEDKKHERHPIFGNIVDEVAYHEKYPTIYHLRKKLVDSTDKADL

RLIYLALAHMIKFRGHFLIEGDLNPDNSDVDKLFIQLVQTYNQLFEENPI

NASGVDAKAILSARLSKSRRLENLIAQLPGEKKNGLFGNLIALSLGLTPN

FKSNFDLAEDAKLQLSKDTYDDDLDNLLAQIGDQYADLFLAAKNLSDAIL

LSDILRVNTEITKAPLSASMIKRYDEHHQDLTLLKALVRQQLPEKYKEIF

FDQSKNGYAGYIDGGASQEEFYKFIKPILEKMDGTEELLVKLNREDLLRK

QRTFDNGSIPHQIHLGELHAILRRQEDFYPFLKDNREKIEKILTFRIPYY

VGPLARGNSRFAWMTRKSEETITPWNFEEVVDKGASAQSFIERMTNFDKN

LPNEKVLPKHSLLYEYFTVYNELTKVKYVTEGMRKPAFLSGEQKKAIVDL

LFKTNRKVTVKQLKEDYFKKIECFDSVEISGVEDRFNASLGTYHDLLKII

KDKDFLDNEENEDILEDIVLTLTLFEDREMIEERLKTYAHLFDDKVMKQL

KRRRYTGWGRLSRKLINGIRDKQSGKTILDFLKSDGFANRNFMQLIHDDS

LTFKEDIQKAQVSGQGDSLHEHIANLAGSPAIKKGILQTVKVVDELVKVM

GRHKPENIVIEMARENQTTQKGQKNSRERMKRIEEGIKELGSQILKEHPV

ENTQLQNEKLYLYYLQNGRDMYVDQELDINRLSDYDVDHIVPQSFLKDDS

IDNKVLTRSDKNRGKSDNVPSEEVVKKMKNYWRQLLNAKLITQRKFDNLT

KAERGGLSELDKAGFIKRQLVETRQITKHVAQILDSRMNTKYDENDKLIR

EVKVITLKSKLVSDFRKDFQFYKVREINNYHHAHDAYLNAVVGTALIKKY

PKLESEFVYGDYKVYDVRKMIAKSEQEIGKATAKYFFYSNIMNFFKTEIT

LANGEIRKRPLIETNGETGEIVWDKGRDFATVRKVLSMPQVNIVKKTEVQ

TGGFSKESILPKRNSDKLIARKKDWDPKKYGGFVSPTVAYSVLVVAKVEK

GKSKKLKSVKELLGITIMERSSFEKNPIDFLEAKGYKEVKKDLIIKLPKY

SLFELENGRKRMLASARELQKGNELALPSKYVNFLYLASHYEKLKGSPED

NEQKQLFVEQHKHYLDEIIEQISEFSKRVILADANLDKVLSAYNKHRDKP

IREQAENIIHLFTLTNLGAPAAFKYFDTTIDRKEYRSTKEVLDATLIHQS

ITGLYETRIDLSQLGGD

Residues V1134, R1217, Q1334, and R1336 of SEQ ID NO: 62, which can be mutated from D1134, G1217, R1334, and T1336 of SEQ ID NO: 58 to yield a SpVRER Cas9, are underlined and in bold.

High Fidelity Cas9 Domains

Some aspects of the disclosure provide high fidelity Cas9 domains of the nucleobase editors provided herein. In some embodiments, high fidelity Cas9 domains are engineered Cas9 domains comprising one or more mutations that decrease electrostatic interactions between the Cas9 domain and the sugar-phosphate backbone of DNA, as compared to a corresponding wild-type Cas9 domain. Without wishing to be bound by any particular theory, high fidelity Cas9 domains that have decreased electrostatic interactions with the sugar-phosphate backbone of DNA may have less off-target effects. In some embodiments, the Cas9 domain (e.g., a wild type Cas9 domain) comprises one or more mutations that decreases the association between the Cas9 domain and the sugar-phosphate backbone of DNA. In some embodiments, a Cas9 domain comprises one or more mutations that decreases the association between the Cas9 domain and the sugar-phosphate backbone of DNA by at least 1%, at least 2%, at least 3%, at least 4%, at least 5%, at least 10%, at least 15%, at least 20%, at least 25%, at least 30%, at least 35%, at least 40%, at least 45%, at least 50%, at least 55%, at least 60%, at least 65%, at least 70%, or more.

In some embodiments, any of the Cas9 fusion proteins provided herein comprise one or more of N497X, R661X, Q695X, and/or Q926X mutation of the amino acid sequence provided in SEQ ID NO: 52, or a corresponding mutation in any of the amino acid sequences provided in SEQ ID NOs: 108-357, wherein X is any amino acid. In some embodiments, any of the Cas9 fusion proteins provided herein comprise one or more of N497A, R661A, Q695A, and/or Q926A mutation of the amino acid sequence provided in SEQ ID NO: 52, or a corresponding mutation in any of the amino acid sequences provided in SEQ ID NOs: 108-357. In some embodiments, the Cas9 domain comprises a D10A mutation of the amino acid sequence provided in SEQ ID NO: 52, or a corresponding mutation in any of the amino acid sequences provided in SEQ ID NOs: 108-357. In some embodiments, the Cas9 domain (e.g., of any of the fusion proteins provided herein) comprises the amino acid sequence as set forth in SEQ ID NO: 62. Cas9 domains with high fidelity are known in the art and would be apparent to the skilled artisan. For example, Cas9 domains with high fidelity have been described in Kleinstiver, B. P., et al. "High-fidelity CRISPR-Cas9 nucleases with no detectable genome-wide off-target effects." *Nature* 529, 490-495 (2016); and Slaymaker, I. M., et al. "Rationally engineered Cas9 nucleases with improved specificity." *Science* 351, 84-88 (2015); the entire contents of each are incorporated herein by reference.

It should be appreciated that any of the base editors provided herein, for example, any of the adenosine deaminase base editors provided herein, may be converted into high fidelity base editors by modifying the Cas9 domain as described herein to generate high fidelity base editors, for example, a high fidelity adenosine base editor. In some embodiments, the high fidelity Cas9 domain is a dCas9 domain. In some embodiments, the high fidelity Cas9 domain is a nCas9 domain.

High Fidelity Cas9 Domain where Mutations Relative to Cas9 of SEQ ID NO: 10 are Shown in Bold and Underlines (SEQ ID NO: 63)
DKKYSIGLAIGTNSVGWAVITDEYKVPSKKFKVLGNTDRHSIKKNLIG

ALLFDSGETAEATRLKRTARRRYTRRKNRICYLQEIFSNEMAKVDDSFFH

RLEESFLVEEDKKHERHPIFGNIVDEVAYHEKYPTIYHLRKKLVDSTDKA

DLRLIYLALAHMIKFRGHFLIEGDLNPDNSDVDKLFIQLVQTYNQLFEEN

PINASGVDAKAILSARLSKSRRLENLIAQLPGEKKNGLFGNLIALSLGLT

PNFKSNFDLAEDAKLQLSKDTYDDDLDNLLAQIGDQYADLFLAAKNLSDA

ILLSDILRVNTEITKAPLSASMIKRYDEHHQDLTLLKALVRQQLPEKYKE

IFFDQSKNGYAGYIDGGASQEEFYKFIKPILEKMDGTEELLVKLNREDLL

RKQRTFDNGSIPHQIHLGELHAILRRQEDFYPFLKDNREKIEKILTFRIP

YYVGPLARGNSRFAWMTRKSEETITPWNFEEVVDKGASAQSFIERMTAFD

KNLPNEKVLPKHSLLYEYFTVYNELTKVKYVTEGMRKPAFLSGEQKKAIV

-continued

```
DLLFKTNRKVTVKQLKEDYFKKIECFDSVEISGVEDRFNASLGTYHDLLK

IIKDKDFLDNEENEDILEDIVLTLTLFEDREMIEERLKTYAHLFDDKVMK

QLKRRRYTGWGALSRKLINGIRDKQSGKTILDFLKSDGFANRNFMALIHD

DSLTFKEDIQKAQVSGQGDSLHEHIANLAGSPAIKKGILQTVKVVDELVK

VMGRHKPENIVIEMARENQTTQKGQKNSRERMKRIEEGIKELGSQILKEH

PVENTQLQNEKLYLYYLQNGRDMYVDQELDINRLSDYDVDHIVPQSFLKD

DSIDNKVLTRSDKNRGKSDNVPSEEVVKKMKNYWRQLLNAKLITQRKFDN

LTKAERGGLSELDKAGFIKRQLVETRAITKHVAQILDSRMNTKYDENDKL

IREVKVITLKSKLVSDFRKDFQFYKVREINNYHHAHDAYLNAVVGTALIK

KYPKLESEFVYGDYKVYDVRKMIAKSEQEIGKATAKYFFYSNIMNFFKTE

ITLANGEIRKRPLIETNGETGEIVWDKGRDFATVRKVLSMPQVNIVKKTE

VQTGGFSKESILPKRNSDKLIARKKDWDPKKYGGFDSPTVAYSVLVVAKV

EKGKSKKLKSVKELLGITIMERSSFEKNPIDFLEAKGYKEVKKDLIIKLP

KYSLFELENGRKRMLASAGELQKGNELALPSKYVNFLYLASHYEKLKGSP

EDNEQKQLFVEQHKHYLDEIIEQISEFSKRVILADANLDKVLSAYNKHRD

KPIREQAENIIHLFTLTNLGAPAAFKYFDTTIDRKRYTSTKEVLDATLIH

QSITGLYETRIDLSQLGGD
```

Nucleic Acid Programmable DNA Binding Proteins

Some aspects of the disclosure provide nucleic acid programmable DNA binding proteins, which may be used to guide a protein, such as a base editor, to a specific nucleic acid (e.g., DNA or RNA) sequence. Nucleic acid programmable DNA binding proteins include, without limitation, Cas9 (e.g., dCas9 and nCas9), CasX, CasY, Cpf1, C2c1, C2c2, C2C3, and Argonaute. One example of an nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from *Acidaminococcus* and *Lachnospiraceae* are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference.

Also useful in the present compositions and methods are nuclease-inactive Cpf1 (dCpf1) variants that may be used as a guide nucleotide sequence-programmable DNA-binding protein domain. The Cpf1 protein has a RuvC-like endonuclease domain that is similar to the RuvC domain of Cas9 but does not have a HNH endonuclease domain, and the N-terminal of Cpf1 does not have the alfa-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity. For example, mutations corresponding to D917A, E1006A, or D1255A in *Francisella novicida* Cpf1 (SEQ ID NO: 382) inactivates Cpf1 nuclease activity. In some embodiments, the dCpf1 of the present disclosure comprises mutations corresponding to D917A, E1006A, D1255A, D917A/E1006A, D917A/D1255A, E1006A/D1255A, or D917A/E1006A/D1255A in SEQ ID NO: 376. It is to be understood that any mutations, e.g., substitution mutations, deletions, or insertions that inactivate the RuvC domain of Cpf1, may be used in accordance with the present disclosure.

In some embodiments, the nucleic acid programmable DNA binding protein (napDNAbp) of any of the fusion proteins provided herein may be a Cpf1 protein. In some embodiments, the Cpf1 protein is a Cpf1 nickase (nCpf1). In some embodiments, the Cpf1 protein is a nuclease inactive Cpf1 (dCpf1). In some embodiments, the Cpf1, the nCpf1, or the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 376-382. In some embodiments, the dCpf1 comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 376-382, and comprises mutations corresponding to D917A, E1006A, D1255A, D917A/E1006A, D917A/D1255A, E1006A/D1255A, or D917A/E1006A/D1255A in SEQ ID NO: 376. In some embodiments, the dCpf1 comprises an amino acid sequence of any one SEQ ID NOs: 376-382. It should be appreciated that Cpf1 from other bacterial species may also be used in accordance with the present disclosure.

```
Wild type Francisella novicida Cpf1 (SEQ ID NO: 376)
(D917, E1006, and D1255 are bolded and underlined)
                                           (SEQ ID NO: 376)
MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNONLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI
```

-continued

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKFNDEINLLLKEKANDVHILSIDRGERHLAYYTLVDG

KGNIIKQDTFNIIGNDRMKTNYHDKLAAIEKDRDSARKDWKKINNIKEMKEGYLSQV

VHEIAKLVIEYNAIVVFEDLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDADANGAYHIGLKGLMLLGRI

KNNQEGKKLNLVIKNEEYFEFVQNRNN

*Francisella novicida* Cpf1 D917A (SEQ ID NO: 377) (A917,
E1006, and D1255 are bolded and underlined)

(SEQ ID NO: 377)

MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNQNLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKENDEINLLLKEKANDVHILSIARGERHLAYYTLVDG

KGNIIKQDTFNIIGNDRMKTNYHDKLAAIEKDRDSARKDWKKINNIKEMKEGYLSQV

VHEIAKLVIEYNAIVVFEDLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDADANGAYHIGLKGLMLLGRI

KNNQEGKKLNLVIKNEEYFEFVQNRNN

*Francisella novicida* Cpf1 E1006A (SEQ ID NO: 378) (D917, A1006, and D1255 are bolded and underlined)

-continued (SEQ ID NO: 378)

MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNONLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKENDEINLLLKEKANDVHILSI<u>D</u>RGERHLAYYTLVDG

KGNIIKQDTFNIIGNDRMKTNYHDKLAAIEKDRDSARKDWKKINNIKEMKEGYLSQV

VHEIAKLVIEYNAIVVF<u>A</u>DLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDA<u>D</u>ANGAYHIGLKGLMLLGRI

KNNQEGKKLNLVIKNEEYFEFVQNRNN

*Francisella novicida* Cpf1 D1255A (SEQ ID NO: 379) (D917, E1006, and A1255 are bolded and underlined)

(SEQ ID NO: 379)

MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNQNLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKFNDEINLLLKEKANDVHILSI<u>D</u>RGERHLAYYTLVDG

-continued

KGNIIKQDTFNIIGNDRMKTNYHDKLAAIEKDRDSARKDWKKINNIKEMKEGYLSQV

VHEIAKLVIEYNAIVVFEDLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDAAANGAYHIGLKGLMLLGRI

KNNQEGKKLNLVIKNEEYFEFVQNRNN

*Francisella novicida* Cpf1 D917A/E1006A (SEQ ID NO: 380)
(A917, A1006, and D1255 are bolded and underlined)
(SEQ ID NO: 380)
MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNONLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVESLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKFNDEINLLLKEKANDVHILSIARGERHLAYYTLVDG

KGNIIKQDTFNIIGNDRMKTNYHDKLAAIEKDRDSARKDWKKINNIKEMKEGYLSQV

VHEIAKLVIEYNAIVVFADLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDADANGAYHIGLKGLMLLGRI

KNNQEGKKLNLVIKNEEYFEFVQNRNN

*Francisella novicida* Cpf1 D917A/D1255A (SEQ ID NO: 381)
(A917, E1006, and A1255 are bolded and underlined)
(SEQ ID NO: 381)

MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNONLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKENDEINLLLKEKANDVHILSIARGERHLAYYTLVDG

KGNIIKQDTFNIIGNDRMKTNYHDKLAAIEKDRDSARKDWKKINNIKEMKEGYLSQV

VHEIAKLVIEYNAIVVFEDLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDAAANGAYHIGLKGLMLLGRI

KNNQEGKKLNLVIKNEEYFEFVQNRNN

*Francisella novicida* Cpf1 E1006A/D1255A (SEQ ID NO: 382)
(D917, A1006, and A1255 are bolded and underlined)
(SEQ ID NO: 382)
MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNONLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKENDEINLLLKEKANDVHILSIDRGERHLAYYTLVDG

KGNIIKQDTFNIIGNDRMKTNYHDKLAAIEKDRDSARKDWKKINNIKEMKEGYLSQV

VHEIAKLVIEYNAIVVFADLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDAAANGAYHIGLKGLMLLGRI

KNNQEGKKLNLVIKNEEYFEFVQNRNN

Francisella novicida Cpf1 D917A/E1006A/D1255A (SEQ ID
NO: 383) (A917, A1006, and A1255 are bolded and underlined)

(SEQ ID NO: 383)

MSIYQEFVNKYSLSKTLRFELIPQGKTLENIKARGLILDDEKRAKDYKKAKQIIDKYH

QFFIEEILSSVCISEDLLQNYSDVYFKLKKSDDDNLQKDFKSAKDTIKKQISEYIKDSE

KFKNLFNQNLIDAKKGQESDLILWLKQSKDNGIELFKANSDITDIDEALEIIKSFKGWT

TYFKGFHENRKNVYSSNDIPTSIIYRIVDDNLPKFLENKAKYESLKDKAPEAINYEQIK

KDLAEELTFDIDYKTSEVNQRVFSLDEVFEIANFNNYLNQSGITKENTIIGGKFVNGEN

TKRKGINEYINLYSQQINDKTLKKYKMSVLFKQILSDTESKSFVIDKLEDDSDVVTTM

QSFYEQIAAFKTVEEKSIKETLSLLFDDLKAQKLDLSKIYFKNDKSLTDLSQQVEDDY

SVIGTAVLEYITQQIAPKNLDNPSKKEQELIAKKTEKAKYLSLETIKLALEEFNKHRDI

DKQCRFEEILANFAAIPMIFDEIAQNKDNLAQISIKYQNQGKKDLLQASAEDDVKAIK

DLLDQTNNLLHKLKIFHISQSEDKANILDKDEHFYLVFEECYFELANIVPLYNKIRNYI

TQKPYSDEKFKLNFENSTLANGWDKNKEPDNTAILFIKDDKYYLGVMNKKNNKIFD

DKAIKENKGEGYKKIVYKLLPGANKMLPKVFFSAKSIKFYNPSEDILRIRNHSTHTKN

GSPQKGYEKFEFNIEDCRKFIDFYKQSISKHPEWKDFGFRFSDTQRYNSIDEFYREVE

NQGYKLTFENISESYIDSVVNQGKLYLFQIYNKDFSAYSKGRPNLHTLYWKALFDER

NLQDVVYKLNGEAELFYRKQSIPKKITHPAKEAIANKNKDNPKKESVFEYDLIKDKR

FTEDKFFFHCPITINFKSSGANKENDEINLLLKEKANDVHILSIARGERHLAYYTLVDG

KGNIIKQDTFNIIGNDRMKTNYHDKLAAIEKDRDSARKDWKKINNIKEMKEGYLSQV

VHEIAKLVIEYNAIVVFADLNFGFKRGRFKVEKQVYQKLEKMLIEKLNYLVFKDNEF

DKTGGVLRAYQLTAPFETFKKMGKQTGIIYYVPAGFTSKICPVTGFVNQLYPKYESV

SKSQEFFSKFDKICYNLDKGYFEFSFDYKNFGDKAAKGKWTIASFGSRLINFRNSDKN

HNWDTREVYPTKELEKLLKDYSIEYGHGECIKAAICGESDKKFFAKLTSVLNTILQM

RNSKTGTELDYLISPVADVNGNFFDSRQAPKNMPQDAAANGAYHIGLKGLMLLGRI

KNNQEGKKLNLVIKNEEYFEFVQNRNN

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.*, 2016 July; 34(7):768-73. PubMed PMID: 27136078; Swarts et al., *Nature*. 507(7491) (2014): 258-61; and Swarts et al., *Nucleic Acids Res.* 43(10) (2015): 5120-9, each of which is incorporated herein by reference. The sequence of *Natronobacterium gregoryi* Argonaute is provided in SEQ ID NO: 416.

Wild type *Natronobacterium gregoryi* Argonaute (SEQ ID NO: 416)

(SEQ ID NO: 416)

MTVIDLDSTTTADELTSGHTYDISVTLTGVYDNTDEQHPRMSLAFEQDNGE

RRYITLWKNTTPKDVFTYDYATGSTYIFTNIDYEVKDGYENLTATYQTTVE

NATAQEVGTTDEDETFAGGEPLDHHLDDALNETPDDAETESDSGHVMTSFA

SRDQLPEWTLHTYTLTATDGAKTDTEYARRTLAYTVRQELYTDHDAAPVAT

DGLMLLTPEPLGETPLDLDCGVRVEADETRTLDYTTAKDRLLARELVEEGL

KRSLWDDYLVRGIDEVLSKEPVLTCDEFDLHERYDLSVEVGHSGRAYLHIN

FRHRFVPKLTLADIDDDNIYPGLRVKTTYRPRRGHIVWGLRDECATDSLNT

LGNQSVVAYHRNNQTPINTDLLDAIEAADRRVVETRRQGHGDDAVSFPQEL

LAVEPNTHQIKQFASDGFHQQARSKTRLSASRCSEKAQAFAERLDPVRLNG

STVEFSSEFFTGNNEQQLRLLYENGESVLTFRDGARGAHPDETFSKGIVNP

PESFEVAVVLPEQQADTCKAQWDTMADLLNQAGAPPTRSETVQYDAFSSPE

SISLNVAGAIDPSEVDAAFVVLPPDQEGFADLASPTETYDELKKALANMGI

YSQMAYFDRFRDAKIFYTRNVALGLLAAAGGVAFTTEHAMPGDADMFIGID

VSRSYPEDGASGQINIAATATAVYKDGTILGHSSTRPQLGEKLQSTDVRDI

```
-continued
MKNAILGYQQVTGESPTHIVIHRDGFMNEDLDPATEFLNEQGVEYDIVEIR

KQPQTRLLAVSDVQYDTPVKSIAAINQNEPRATVATFGAPEYLATRDGGGL

PRPIQIERVAGETDIETLTRQVYLLSQSHIQVHNSTARLPITTAYADQAST

HATKGYLVQTGAFESNVGFL
```

In some embodiments, the napDNAbp is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the nap-DNAbp is a Marinitoga piezophila Argunaute (MpAgo) protein. The CRISPR-associated Marinitoga piezophila Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the nucleic acid programmable DNA binding protein (napDNAbp) is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR-Cas systems (C2c1, C2c2, and C2c3) have been described by Shmakov et al., "Discovery and Functional Characterization of Diverse Class 2 CRISPR Cas Systems", *Mol. Cell,* 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c 1. C2c 1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in *Leptotrichia shahii* has shown that C2c2 is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of *Alicyclobaccillus acidoterrastris* C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the nucleic acid programmable DNA binding protein (napDNAbp) of any of the fusion proteins provided herein may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to a naturally-occurring C2c1, C2c2, or C2c3 protein. In some embodiments, the napDNAbp is a naturally-occurring C2c1, C2c2, or C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at ease 99.5% identical to any one of SEQ ID NOs: 438 or 439. In some embodiments, the napDNAbp comprises an amino acid sequence of any one SEQ ID NOs: 438 or 439. It should be appreciated that C2c1, C2c2, or C2c3 from other bacterial species may also be used in accordance with the present disclosure.

```
C2c1 (uniprot.org/uniprot/T0D7A2#)
sp|T0D7A2|C2C1_ALIAG CRISPR-associated
endonuclease C2c1 OS = Alicyclobacillus
acidoterrestris (strain ATCC 49025/DSM 3922/
CIP 106132/NCIMB 13137/GD3B) GN = c2c1 PE = 1
SV = 1
                                    (SEQ ID NO: 438)
MAVKSIKVKLRLDDMPEIRAGLWKLHKEVNAGVRYYTEWLSLLRQENLYR

RSPNGDGEQECDKTAEECKAELLERLRARQVENGHRGPAGSDDELLQLAR

QLYELLVPQAIGAKGDAQQIARKFLSPLADKDAVGGLGIAKAGNKPRWVR

MREAGEPGWEEEKEKAETRKSADRTADVLRALADFGLKPLMRVYTDSEMS

SVEWKPLRKGQAVRTWDRDMFQQAIERMMSWESWNQRVGQEYAKLVEQKN

RFEQKNFVGQEHLVHLVNQLQQDMKEASPGLESKEQTAHYVTGRALRGSD
```

-continued

KVFEKWGKLAPDAPFDLYDAEIKNVQRRNTRRFGSHDLFAKLAEPEYQAL

WREDASFLTRYAVYNSILRKLNHAKMFATFTLPDATAHPIWTRFDKLGGN

LHQYTFLFNEFGERRHAIRFHKLLKVENGVAREVDDVTVPISMSEQLDNL

LPRDPNEPIALYFRDYGAEQHFTGEFGGAKIQCRRDQLAHMHRRRGARDV

YLNVSVRVQSQSEARGERRPPYAAVFRLVGDNHRAFVHFDKLSDYLAEHP

DDGKLGSEGLLSGLRVMSVDLGLRTSASISVFRVARKDELKPNSKGRVPF

FFPIKGNDNLVAVHERSQLLKLPGETESKDLRAIREERQRTLRQLRTQLA

YLRLLVRCGSEDVGRRERSWAKLIEQPVDAANHMTPDWREAFENELQKLK

SLHGICSDKEWMDAVYESVRRVWRHMGKQVRDWRKDVRSGERPKIRGYAK

DVVGGNSIEQIEYLERQYKFLKSWSFFGKVSGQVIRAEKGSRFAITLREH

IDHAKEDRLKKLADRIIMEALGYVYALDERGKGKWVAKYPPCQLILLEEL

SEYQFNNDRPPSENNQLMQWSHRGVFQELINQAQVHDLLVGTMYAAFSSR

FDARTGAPGIRCRRVPARCTQEHNPEPFPWWLNKFVVEHTLDACPLRADD

LIPTGEGEIFVSPESAEEGDFHQIHADLNAAQNLQQRLWSDFDISQIRLR

CDWGEVDGELVLIPRLTGKRTADSYSNKVFYTNTGVTYYERERGKKRRKV

FAQEKLSEEEAELLVEADEAREKSVVLMRDPSGIINRGNWTRQKEFWSMV

NQRIEGYLVKQIRSRVPLQDSACENTGDI

C2c2 (uniprot.org/uniprot/P0DOC6)
>sp|P0DOC6|C2C2_LEPSD CRISPR-associated
endoribonuclease C2c2 OS = Leptotrichia shahii
(strain DSM 19757/CCUG 47503/CIP 107916/JCM
16776/LB37) GN = c2c2 PE = 1 SV = 1
(SEQ ID NO: 439)
MGNLFGHKRWYEVRDKKDFKIKRKVKVKRNYDGNKYILNINENNNKEKID

NNKFIRKYINYKKNDNILKEFTRKFHAGNILFKLKGKEGIIRIENNDDFL

ETEEVVLYIEAYGKSEKLKALGITKKKIIDEAIRQGITKDDKKIEIKRQE

NEEEIEIDIRDEYTNKTLNDCSIILRIIENDELETKKSIYEIFKNINMSL

YKIIEKIIENETEKVFENRYYEEHLREKLLKDDKIDVILTNFMEIREKIK

SNLEILGFVKFYLNVGGDKKKSKNKKMLVEKILNINVDLTVEDIADFVIK

ELEFWNITKRIEKVKKVNNEFLEKRRNRTYIKSYVLLDKHEKFKIERENK

KDKIVKFFVENIKNNSIKEKIEKILAEFKIDELIKKLEKELKKGNCDTEI

FGIFKKHYKVNFDSKKFSKKSDEEKELYKIIYRYLKGRIEKILVNEQKVR

LKKMEKIEIEKILNESILSEKILKRVKQYTLEHIMYLGKLRHNDIDMTTV

NTDDFSRLHAKEELDLELITFFASTNMELNKIFSRENINNDENIDFFGGD

REKNYVLDKKILNSKIKIIRDLDFIDNKNNITNNFIRKFTKIGTNERNRI

LHAISKERDLQGTQDDYNKVINIIQNLKISDEEVSKALNLDVVFKDKKNI

ITKINDIKISEENNNDIKYLPSFSKVLPEILNLYRNNPKNEPFDTIETEK

IVLNALIYVNKELYKKLILEDDLEENESKNIFLQELKKTLGNIDEIDENI

IENYYKNAQISASKGNNKAIKKYQKKVIECYIGYLRKNYEELFDFSDFKM

NIQEIKKQIKDINDNKTYERITVKTSDKTIVINDDFEYIISIFALLNSNA

VINKIRNRFFATSVWLNTSEYQNIIDILDEIMQLNTLRNECITENWNLNL

EEFIQKMKEIEKDFDDFKIQTKKEIFNNYYEDIKNNILTEFKDDINGCDV

LEKKLEKIVIFDDETKFEIDKKSNILQDEQRKLSNINKKDLKKKVDQYIK

DKDQEIKSKILCRIIFNSDFLKKYKKEIDNLIEDMESENENKFQEIYYPK

ERKNELYIYKKNLFLNIGNPNFDKIYGLISNDIKMADAKFLFNIDGKNIR

KNKISEIDAILKNLNDKLNGYSKEYKEKYIKKLKENDDFFAKNIQNKNYK

SFEKDYNRVSEYKKIRDLVEFNYLNKIESYLIDINWKLAIQMARFERDMH

YIVNGLRELGIIKLSGYNTGISRAYPKRNGSDGFYTTTAYYKFFDEESYK

DKFEKICYGFGIDLSENSEINKPENESIRNYISHFYIVRNPFADYSIAEQ

IRVSNLLSYSTRYNNSTYASVFEVFKKDVNLDYDELKKKFKLIGNNDILE

RLMKPKKVSVLELESYNSDYIKNLIIELLTKIENTNDTL

Fusion Proteins Comprising a Nuclease Programmable DNA Binding Protein and an Adenosine Deaminase Some aspects of the disclosure provide fusion proteins comprising a nucleic acid programmable DNA binding protein (napDNAbp) and an adenosine deaminase. In some embodiments, any of the fusion proteins provided herein are base editors. In some embodiments, the napDNAbp is a Cas9 domain, a Cpf1 domain, a CasX domain, a CasY domain, a C2c1 domain, a C2c2 domain, aC2c3 domain, or an Argonaute domain. In some embodiments, the napDNAbp is any napDNAbp provided herein. Some aspects of the disclosure provide fusion proteins comprising a Cas9 domain and an adenosine deaminase. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases provided herein. In some embodiments, the fusion protein comprises the structure:

NH$_2$-[adenosine deaminase]-[napDNAbp]-COOH; or

NH$_2$-[napDNAbp]-[adenosine deaminase]-COOH

In some embodiments, the fusion proteins comprising an adenosine deaminase and a napDNAbp (e.g., Cas9 domain) do not include a linker sequence. In some embodiments, a linker is present between the adenosine deaminase domain and the napDNAbp. In some embodiments, the "-" used in the general architecture above indicates the presence of an optional linker. In some embodiments, the adenosine deaminase and the napDNAbp are fused via any of the linkers provided herein. For example, in some embodiments the adenosine deaminase and the napDNAbp are fused via any of the linkers provided below in the section entitled "Linkers". In some embodiments, the adenosine deaminase and the napDNAbp are fused via a linker that comprises between 1 and and 200 amino acids. In some embodiments, the adenosine deaminase and the napDNAbp are fused via a linker that comprises from 1 to 5, 1 to 10, 1 to 20, 1 to 30, 1 to 40, 1 to 50, 1 to 60, 1 to 80, 1 to 100, 1 to 150, 1 to 200, 5 to 10, 5 to 20, 5 to 30, 5 to 40, 5 to 60, 5 to 80, 5 to 100, 5 to 150, 5 to 200, 10 to 20, 10 to 30, 10 to 40, 10 to 50, 10 to 60, 10 to 80, 10 to 100, 10 to 150, 10 to 200, 20 to 30, 20 to 40, 20 to 50, 20 to 60, 20 to 80, 20 to 100, 20 to 150, 20 to 200, 30 to 40, 30 to 50, 30 to 60, 30 to 80, 30 to 100, 30 to 150, 30 to 200, 40 to 50, 40 to 60, 40 to 80, 40 to 100, 40 to 150, 40 to 200, 50 to 60 50 to 80, 50 to 100, 50 to 150, 50 to 200, 60 to 80, 60 to 100, 60 to 150, 60 to 200, 80 to 100, 80 to 150, 80 to 200, 100 to 150, 100 to 200, or 150 to 200 amino acids in length. In some embodiments, the adenosine deaminase and the napDNAbp are fused via a linker that comprises 4, 16, 32, or 104 amino acids in length.

In some embodiments, the adenosine deaminase and the napDNAbp are fused via a linker that comprises the amino acid sequence of

SGSETPGTSESATPES, (SEQ ID NO: 10)

SGGS, (SEQ ID NO: 37)

SGGSSGSETPGTSESATPESSGGS, (SEQ ID NO: 384)

SGGSSGGSSGSETPGTSESATPESSGGSSGGS, (SEQ ID NO: 385)
or

GGSGGSPGSPAGSPTSTEEGTSESATPESGPGTSTEPSEGSAPGSPAGS PTSTEEGTSTEPSEGSAPGTSTEPSEGSAPGTSESATPESGPGSEPATS GGSGGS. (SEQ ID NO: 386)

In some embodiments, the adenosine deaminase and the napDNAbp are fused via a linker comprising the amino acid sequence

SGSETPGTSESATPES, (SEQ ID NO: 10)

which may also be referred to as the XTEN linker. In some embodiments, the linker is 24 amino acids in length. In some embodiments, the linker comprises the amino acid sequence

SGGSSGGSSGSETPGTSESATPES. (SEQ ID NO: 685)

In some embodiments, the linker is 40 amino acids in length. In some embodiments, the linker comprises the amino acid sequence

SGGSSGGSSGSETPGTSESATPESSGGSSGGSSGGSSGGS. (SEQ ID NO: 686)

In some embodiments, the linker is 64 amino acids in length. In some embodiments, the linker comprises the amino acid sequence SGGSSGGSSGSETPGTSESATPESSGGSSGGSSGGSSGGSSGSETPGTSES ATPESSGGSSGGS. (SEQ ID NO: 687)

In some embodiments, the linker is 92 amino acids in length. In some embodiments, the linker comprises the amino acid sequence PGSPAGSPTSTEEGTSESATPESGPGTSTEPSEGSAPGSPAGSPTSTEEGT STEPSEGSAPGTSTEPSEGSAPGTSESATPESGPGSEPATS. (SEQ ID NO: 688)

Fusion Proteins Comprising an Inhibitor of Base Repair

Some aspects of the disclosure provide fusion proteins that comprise an inhibitor of base repair (IBR). For example a fusion protein comprising an adenosine deaminase and a nucleic acid programmable DNA binding protein may further comprise an inhibitor of base repair. In some embodiments, the IBR comprises an inhibitor of inosine base repair. In some embodiments, the IBR is an inhibitor of inosine base excision repair. In some embodiments, the inhibitor of inosine base excision repair is a catalytically inactive inosine specific nuclease (dISN).

In some embodiments, the fusion proteins provided herein further comprise a catalytically inactive inosine-specific nuclease (dISN). In some embodiments, any of the fusion proteins provided herein that comprise a napDNAbp (e.g., a nuclease active Cas9 domain, a nuclease inactive dCas9 domain, or a Cas9 nickase) and an adenosine deaminase may be further fused to a catalytically inactive inosine-specific nuclease (dISN) either directly or via a linker. Some aspects of this disclosure provide fusion proteins that comprise an adenosine deaminase (e.g., an engineered adenosine deaminase that deaminates adenosine in a DNA) a napDNAbp (e.g., a dCas9 or nCas9), and a dISN. Without wishing to be bound by any particular theory, cellular DNA-repair response to the presence of I:T heteroduplex DNA may be responsible for the decrease in nucleobase editing efficiency in cells. For example, AAG catalyzes removal of inosine (I) from DNA in cells, which may initiate base excision repair, with reversion of the I:T pair to a A:T pair as the most common outcome. In some embodiments, a catalytically inactive inosine-specific nuclease may be capable of binding an inosine in a nucleic acid, without cleaving the nucleic acid, to prevent removal (e.g., by cellular DNA repair mechanisms) of the inosine residue in the DNA.

In some embodiments, a dISN may inhibit (e.g., by steric hindrance) inosine removing enzymes from excising the inosine residue from DNA. For example, catalytically dead inosine glycosylases (e.g., alkyl adenine glycosylase [AAG]) will bind inosine but will not create an abasic site or remove the inosine, thereby sterically blocking the newly-formed inosine moiety from potential DNA damage/repair mechanisms. Thus, this disclosure contemplates a fusion protein comprising a napDNAbp and an adenosine deaminase further fused to a dISN. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a dISN may increase the editing efficiency of a adenosine deaminase that is capable of catalyzing a A to I change. For example, fusion proteins comprising a dISN domain may be more efficient in deaminating A residues. In some embodiments, the fusion protein comprises the structure:

$NH_2$-[adenosine deaminase]-[napDNAbp]-[dISN]-COOH;

$NH_2$-[adenosine deaminase]-[dISN]-[napDNAbp]-COOH;

$NH_2$-[dISN]-[adenosine deaminase]-[napDNAbp]-COOH;

$NH_2$-[napDNAbp]-[adenosine deaminase]-[dISN]-COOH;

$NH_2$-[napDNAbp]-[dISN]-[adenosine deaminase]-COOH; or $NH_2$-[dISN]-[napDNAbp]-[adenosine deaminase]-COOH In some embodiments, the fusion proteins provided herein do not comprise a linker. In some embodiments, a linker is present between two domains or proteins (e.g., adenosine deaminase, napDNAbp, or dISN). In some embodiments, the "-" used in the general architecture above indicates the presence of an optional linker sequence. In some embodiments, a dISN comprises an inosine-specific nuclease that has reduced or nuclease activity, or does not have nuclease activity. In some embodiments, a dISN has up to 1%, up to 2%, up to 3%, up to 4%, up to 5%, up to 10%, up to 15%, up to 20%, up to 25%, up to 30%, up to 35%, up to 40%, up to 45%, or up to 50% of the nuclease activity of a corresponding (e.g., the wild-type) inosine-specific nuclease. In some embodiments, the dISN is a wild-type inosine-specific nuclease that comprises one or more mutations that reduces or eliminates the nuclease activity of the wild-type inosine-specific nuclease. Exemplary catalytically inactive inosine-specific nucleases include, without limitation, catalytically inactive AAG nuclease and catalytically inactive EndoV nuclease. In some embodiments, the catalytically inactive AAG nuclease comprises an E125Q mutation as compared to SEQ ID NO: 32, or a corresponding mutation in another AAG nuclease. In some embodiments, the catalytically inactive AAG nuclease comprises the amino acid sequence set forth in SEQ ID NO: 32. In some embodiments, the catalytically inactive EndoV nuclease comprises an D35A mutation as compared to SEQ ID NO 32, or a corresponding mutation in another EndoV nuclease. In some embodiments, the catalytically inactive EndoV nuclease comprises the amino acid sequence set forth in SEQ ID NO: 33. It should be appreciated that other catalytically inactive inosine-specific nucleases (dISNs) would be apparent to the skilled artisan and are within the scope of this disclosure.

In some embodiments, the dISN proteins provided herein include fragments of dISN proteins and proteins homologous to a dISN or a dISN fragment. For example, in some embodiments, a dISN comprises a fragment of the amino acid sequence set forth in SEQ ID NO: 32 or 33. In some embodiments, a dISN fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 32 or 33. In some embodiments, a dISN comprises an amino acid sequence homologous to the amino acid sequence set forth in SEQ ID NO: 32 or 33, or an amino acid sequence homologous to a fragment of the amino acid sequence set forth in SEQ ID NO: 32 or 33. In some embodiments, proteins comprising a dISN or fragments of a dISN or homologs of a dISN or a dISN fragment are referred to as "dISN variants." A dISN variant shares homology to a dISN, or a fragment thereof. For example a dISN variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild-type dISN or a dISN as set forth in SEQ ID NO: 32 or 33. In some embodiments, the dISN variant comprises a fragment of dISN, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type dISN or a dISN as set forth in SEQ ID NO: 32 or 33. In some embodiments, the dISN comprises the following amino acid sequence:

AAG nuclease (E125Q); mutated residue underlined in bold.

AAG nuclease (E125Q); mutated residue underlined in bold.

(SEQ ID NO: 32)
KGHLTRLGLEFFDQPAVPLARAFLGQVLVRRLPNGTELRGRIVETQAYLGP

EDEAAHSRGGRQTPRNRGMFMKPGTLYVYIIYGMYFCMNISSQGDGACVLL

RALEPLEGLETMRQLRSTLRKGTASRVLKDRELCSGPSKLCQALAINKSFD

QRDLAQDEAVWLERGPLEPSEPAVVAAARVGVGHAGEWARKPLRFYVRGSP

WVSVVDRVAEQDTQA

EndoV nuclease (D35A); mutated residue underlined in bold.

(SEQ ID NO: 33)
DLASLRAQQIELASSVIREDRLDKDPPDLIAGAAVGFEQGGEVTRAAMVLL

KYPSLELVEYKVARIATTMPYIPGFLSFREYPALLAAWEMLSQKPDLVFVD

GHGISHPRRLGVASHFGLLVDVPTIGVAKKRLCGKFEPLSSEPGALAPLMD

KGEQLAWVWRSKARCNPLFIATGHRVSVDSALAWVQRCMKGYRLPEPTRWA

DAVASERPAFVRYTANQP

Suitable dISN proteins are provided herein and additional suitable dISN proteins are known to those in the art, and include, for example, AAG, EndoV, and variants thereof. It should be appreciated that additional proteins that block or inhibit base-excision repair, such as base excision of an inosine, are also within the scope of this disclosure. In some embodiments, a protein that binds inosine in DNA is used.

Some aspects of the disclosure relate to fusion proteins that comprise MBD4, or TDG, which may be used as inhibitors of base repair. Thus, this disclosure contemplates a fusion protein comprising a napDNAbp and an adenosine deaminase further fused to MBD4 or TDG. This disclosure contemplates a fusion protein comprising any Cas9 domain, for example, a Cas9 nickase (nCas9) domain, a catalytically inactive Cas9 (dCas9) domain, a high fidelity Cas9 domain, or a Cas9 domain with reduced PAM exclusivity. It should be understood that the use of MBD4 or TDG may increase the editing efficiency of a adenosine deaminase that is capable of catalyzing a A to I change. For example, fusion proteins comprising MBD4 or TDG may be more efficient in deaminating A residues. In some embodiments, the fusion protein comprises the structure:

NH₂-[adenosine deaminase]-[napDNAbp]-[MBD4 or TDG]-COOH;

NH2-[adenosine deaminase]-[MBD4 or TDG]-[napDNAbp]-COOH;

NH₂-[MBD4 or TDG]-[adenosine deaminase]-[napDNAbp]-COOH;

NH₂-[napDNAbp]-[adenosine deaminase]-[MBD4 or TDG]-COOH;

NH₂-[napDNAbp]-[MBD4 or TDG]-[adenosine deaminase]-COOH; or

NH₂-[MBD4 or TDG]-[napDNAbp]-[adenosine deaminase]-COOH

In some embodiments, the fusion proteins provided herein do not comprise a linker. In some embodiments, a linker is present between two domains or proteins (e.g., adenosine deaminase, napDNAbp, MBD4 or TDG). In some embodiments, the "-" used in the general architecture above indicates the presence of an optional linker sequence. In some embodiments, the MBD4 or TDG is a wild-type MBD4 or TDG. Exemplary, MBD4 and TDG amino acid sequences would be apparent to the skilled artisan and include, without limitation, the MBD4 and TDG amino acid sequences provided below.

Sequence of MBD4:
(SEQ ID NO: 689)
GTTGLESLSLGDRGAAPTVTSSERLVPDPPNDLRKEDVAMELERVGEDEEQ

MMIKRSSECNPLLQEPIASAQFGATAGTECRKSVPCGWERVVKQRLFGKTA

GRFDVYFISPQGLKFRSKSSLANYLHKNGETSLKPEDFDFTVLSKRGIKSR

YKDCSMAALTSHLQNQSNNSNWNLRTRSKCKKDVFMPPSSSSELQESRGLS

NFTSTHLLLKEDEGVDDVNFRKVRKPKGKVTILKGIPIKKTKKGCRKSCSG

FVQSDSKRESVCNKADAESEPVAQKSQLDRTVCISDAGACGETLSVTSEEN

SLVKKKERSLSSGSNFCSEQKTSGIINKFCSAKDSEHNEKYEDTFLESEEI

GTKVEVVERKEHLHTDILKRGSEMDNNCSPTRKDFTGEKIFQEDTIPRTQI

ERRKTSLYFSSKYNKEALSPPRRKAFKKWTPPRSPFNLVQETLFHDPWKLL

IATIFLNRTSGKMAIPVLWKFLEKYPSAEVARTADWRDVSELLKPLGLYDL

RAKTIVKFSDEYLTKQWKYPIELHGIGKYGNDSYRIFCVNEWKQVHPEDHK

LNKYHDWLWENHEKLSLS

Sequence of TDG:
(SEQ ID NO: 690)
EAENAGSYSLQQAQAFYTFPFQQLMAEAPNMAVVNEQQMPEEVPAPAPAQE

PVQEAPKGRKRKPRTTEPKQPVEPKKPVESKKSGKSAKSKEKQEKITDTFK

VKRKVDRENGVSEAELLTKTLPDILTFNLDIVIIGINPGLMAAYKGHHYPG

PGNHFWKCLFMSGLSEVQLNHMDDHTLPGKYGIGFTNMVERTTPGSKDLSS

KEFREGGRILVQKLQKYQPRIAVFNGKCIYEIFSKEVFGVKVKNLEFGLQP

HKIPDTETLCYVMPSSSARCAQFPRAQDKVHYYIKLKDLRDQLKGIERNMD

VQEVQYTFDLQLAQEDAKKMAVKEEKYDPGYEAAYGGAYGENPCSSEPCGF

SSNGLIESVELRGESAFSGIPNGQWMTQSFTDQIPSFSNHCGTQEQEEESH

A

In some embodiments, the MBD4 or TDG proteins provided herein include fragments of MBD4 or TDG proteins and proteins homologous to a MBD4 or a TDG fragment. For example, in some embodiments, a MBD4 or TDG protein comprises a fragment of the amino acid sequence set forth in SEQ ID NO: 689 or 690. In some embodiments, a MBD4 or TDG fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 689 or 690. In some embodiments, a MBD4 or TDG protein comprises an amino acid sequence homologous to the amino acid sequence set forth in SEQ ID NO: 689 or 690, or an amino acid sequence homologous to a fragment of the amino acid sequence set forth in SEQ ID NO: 689 or 690. In some embodiments, proteins comprising a MBD4 or TDG or fragments of a MBD4 or TDG or homologs of a MBD4 or TDG fragment are referred to as "MBD4 variants" or "TDG variants." A MBD4 or TDG variant shares homology to a MBD4 or TDG, or a fragment thereof. For example a MBD4 or TDG variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild-type MBD4 or TDG or a MBD4 or TDG as set forth in SEQ ID NO: 689 or 690. In some embodiments, the MBD4 or TDG variant comprises a fragment of MBD4 or TDG, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type MBD4 or TDG or a MBD4 or TDG as set forth in SEQ ID NO: 689 or 690. In some embodiments, the dISN comprises the following amino acid sequence:

Some aspects of the disclosure relate to fusion proteins that comprise a uracil glycosylase inhibitor (UGI) domain. In some embodiments, any of the fusion proteins provided herein that comprise a napDNAbp (e.g., a nuclease active Cas9 domain, a nuclease inactive dCas9 domain, or a Cas9 nickase), and an adenosine deaminase, may be further fused to a UGI domain either directly or via a linker. Some aspects of this disclosure provide fusion proteins that comprise an adenosine deaminase (e.g., an engineered adenosine deaminase that deaminates deoxyadenosine in a DNA) a napDNAbp (e.g., a dCas9 or nCas9), and a UGI domain. Without wishing to be bound by any particular theory, the cellular DNA-repair response to the presence of I:T heteroduplex DNA may be responsible for the decrease in nucleobase editing efficiency in cells. For example, alkyl adenosine glycosylase (AAG) is involved in inosine (I) associated DNA repair and catalyzes removal of I from DNA in cells. This may initiate base excision repair, with reversion of the I:T pair to a A:T pair as the most common outcome. A UGI domain, may inhibit (e.g., by steric hindrance) inosine removing enzymes from excising the inosine residue from DNA. Thus, this disclosure contemplates a fusion protein comprising a Cas9 domain and an adenosine deaminase domain further fused to a UGI domain. This disclosure contemplates a fusion protein comprising any nucleic acid programmable DNA binding protein, for example, a Cas9 nickase (nCas9) domain, a catalytically inactive Cas9 (dCas9) domain, a high fidelity Cas9 domain, or a Cas9 domain with reduced PAM exclusivity. It should be understood that the use of a UGI domain may increase the editing efficiency of a adenosine deaminase that is capable of catalyzing a A to I change. For example, fusion proteins comprising a UGI domain may be more efficient in deaminating adenosine residues. In some embodiments, the fusion protein comprises the structure:

NH$_2$-[adenosine deaminase]-[napDNAbp]-[UGI]-COOH;

NH$_2$-[adenosine deaminase]-[UGI]-[napDNAbp]-COOH;

NH$_2$-[UGI]-[adenosine deaminase]-[napDNAbp]-COOH;

NH$_2$-[napDNAbp]-[adenosine deaminase]-[UGI]-COOH;

NH$_2$-[napDNAbp]-[UGI]-[adenosine deaminase]-COOH; or

NH$_2$-[UGI]-[napDNAbp]-[adenosine deaminase]-COOH

In some embodiments, the fusion proteins provided herein do not comprise a linker. In some embodiments, a linker is present between any of the domains or proteins (e.g., adenosine deaminase, napDNAbp, and/or UGI domains). In some embodiments, the "-" used in the general architecture above indicates the presence of an optional linker.

In some embodiments, a UGI domain comprises a wild-type UGI or a UGI as set forth in SEQ ID NO: 3. In some embodiments, the UGI proteins provided herein include fragments of UGI and proteins homologous to a UGI or a UGI fragment. For example, in some embodiments, a UGI domain comprises a fragment of the amino acid sequence set forth in SEQ ID NO: 3. In some embodiments, a UGI fragment comprises an amino acid sequence that comprises at least 60%, at least 65%, at least 70%, at least 75%, at least 80%, at least 85%, at least 90%, at least 95%, at least 96%, at least 97%, at least 98%, at least 99%, or at least 99.5% of the amino acid sequence as set forth in SEQ ID NO: 3. In some embodiments, a UGI comprises an amino acid sequence homologous to the amino acid sequence set forth in SEQ ID NO: 3 or an amino acid sequence homologous to a fragment of the amino acid sequence set forth in SEQ ID NO: 3. In some embodiments, proteins comprising UGI or fragments of UGI or homologs of UGI or UGI fragments are referred to as "UGI variants." A UGI variant shares homology to UGI, or a fragment thereof. For example a UGI variant is at least 70% identical, at least 75% identical, at least 80% identical, at least 85% identical, at least 90% identical, at least 95% identical, at least 96% identical, at least 97% identical, at least 98% identical, at least 99% identical, at least 99.5% identical, or at least 99.9% identical to a wild type UGI or a UGI as set forth in SEQ ID NO: 3. In some embodiments, the UGI variant comprises a fragment of UGI, such that the fragment is at least 70% identical, at least 80% identical, at least 90% identical, at least 95% identical, at least 96% identical, at least 97% identical, at least 98% identical, at least 99% identical, at least 99.5% identical, or at least 99.9% to the corresponding fragment of wild-type UGI or a UGI as set forth in SEQ ID NO: 3. In some embodiments, the UGI comprises the following amino acid sequence:

```
>sp|P14739|UNGI_BPPB2 Uracil-DNA glycosylase
inhibitor
                                    (SEQ ID NO: 3)
MTNLSDIIEKETGKQLVIQESILMLPEEVEEVIGNKPESDILVHTAYDEST

DENVMLLTSDAPEYKPWALVIQDSNGENKIKML
```

Suitable UGI protein and nucleotide sequences are provided herein and additional suitable UGI sequences are known to those in the art, and include, for example, those published in Wang et al., Uracil-DNA glycosylase inhibitor gene of bacteriophage PBS2 encodes a binding protein specific for uracil-DNA glycosylase. *J. Biol. Chem.* 264: 1163-1171(1989); Lundquist et al., Site-directed mutagenesis and characterization of uracil-DNA glycosylase inhibitor protein. Role of specific carboxylic amino acids in complex formation with *Escherichia coli* uracil-DNA glycosylase. *J. Biol. Chem.* 272:21408-21419(1997); Ravishankar et al., X-ray analysis of a complex of *Escherichia coli* uracil DNA glycosylase (EcUDG) with a proteinaceous inhibitor. The structure elucidation of a prokaryotic UDG. *Nucleic Acids Res.* 26:4880-4887(1998); and Putnam et al., Protein mimicry of DNA from crystal structures of the uracil-DNA glycosylase inhibitor protein and its complex with *Escherichia coli* uracil-DNA glycosylase. *J. Mol. Biol.* 287:331-346(1999), the entire contents of each are incorporated herein by reference.

It should be appreciated that additional proteins that block or inhibit base-excision repair, such as base excision of an inosine, are also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, the single-stranded binding protein comprises the amino acid sequence (SEQ ID NO: 29). In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. For example, a uracil glycosylase inhibitor is a UdgX. In some embodiments, the UdgX comprises the amino acid sequence (SEQ ID NO: 30). As another example, a uracil glycosylase inhibitor is a catalytically inactive UDG. In some embodiments, a catalytically inactive UDG comprises the amino acid sequence (SEQ ID NO: 31). It should be appreciated that other uracil glycosylase inhibitors would be apparent to the skilled artisan and are within the scope of this disclosure. In some embodiments, a uracil glycosylase inhibitor is a protein that is homologous to any one of SEQ ID NOs: 29-31. In some embodiments, a uracil glycosylase inhibitor is a protein that is at least 50% identical, at least 55% identical, at least 60% identical, at least 65% identical, at least 70% identical, at least 75% identical, at least 80% identical at least 85% identical, at least 90% identical, at least 95% identical, at least 96% identical, at least 98% identical, at least 99% identical, or at least 99.5% identical to any one of SEQ ID NOs: 29-31.

```
Erwinia tasmaniensis SSB (themostable single-
strandedDNA binding protein)
                                    (SEQ ID NO: 29)
MASRGVNKVILVGNLGQDPEVRYMPNGGAVANITLATSESWRDKQTGETKE

KTEWHRVVLFGKLAEVAGEYLRKGSQVYIEGALQTRKWTDQAGVEKYTTEV

VVNVGGTMQMLGGRSQGGGASAGGQNGGSNNGWGQPQQPQGGNQFSGGAQQ

QARPQQQPQQNNAPANNEPPIDFDDDIP

UdgX (binds to Uracil in DNA but does not excise)
                                    (SEQ ID NO: 30)
MAGAQDFVPHTADLAELAAAAGECRGCGLYRDATQAVFGAGGRSARIMMIG

EQPGDKEDLAGLPFVGPAGRLLDRALEAADIDRDALYVTNAVKHFKFTRAA

GGKRRIHKTPSRTEVVACRPWLIAEMTSVEPDVVVLLGATAAKALLGNDFR

VTQHRGEVLHVDDVPGDPALVATVHPSSLLRGPKEERESAFAGLVDDLRVA

ADVRP

UDG (catalytically inactive human UDG, binds to
Uracil in DNA but does not excise)
                                    (SEQ ID NO: 31)
MIGQKTLYSFFSPSPARKRHAPSPEPAVQGTGVAGVPEESGDAAAIPAKKA

PAGQEEPGTPPSSPLSAEQLDRIQRNKAAALLRLAARNVPVGFGESWKKHL

SGEFGKPYFIKLMGFVAEERKHYTVYPPPHQVFTWTQMCDIKDVKVVILGQ

EPYHGPNQAHGLCFSVQRPVPPPPSLENIYKELSTDIEDFVHPGHGDLSGW

AKQGVLLLNAVLTVRAHQANSHKERGWEQFTDAVVSWLNQNSNGLVFLLWG
```

-continued

SYAQKKGSAIDRKRHHVLQTAHPSPLSVYRGFFGCRHFSKTNELLQKSGKK
PIDWKEL

Fusion Proteins Comprising a Nuclear Localization Sequence (NLS)

In some embodiments, the fusion proteins provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In some embodiments, the NLS is fused to the N-terminus of the fusion protein. In some embodiments, the NLS is fused to the C-terminus of the fusion protein. In some embodiments, the NLS is fused to the N-terminus of the IBR (e.g., dISN). In some embodiments, the NLS is fused to the C-terminus of the IBR (e.g., dISN). In some embodiments, the NLS is fused to the N-terminus of the napDNAbp. In some embodiments, the NLS is fused to the C-terminus of the napDNAbp. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 4 or SEQ ID NO: 5. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 4) or MDSLLMNRRKFLY-QFKNVRWAKGRRETYLC (SEQ ID NO: 5).

In some embodiments, the general architecture of exemplary fusion proteins with an adenosine deaminase and a napDNAbp comprises any one of the following structures, where NLS is a nuclear localization sequence (e.g., any NLS provided herein), NH$_2$ is the N-terminus of the fusion protein, and COOH is the C-terminus of the fusion protein.

Fusion proteins comprising an adenosine deaminase, a napDNAbp, and a NLS.

NH$_2$-[NLS]-[adenosine deaminase]-[napDNAbp]-COOH;

NH$_2$-[adenosine deaminase]-[NLS]-[napDNAbp]-COOH;

NH$_2$-[adenosine deaminase]-[napDNAbp]-[NLS]-COOH;

NH$_2$-[NLS]-[napDNAbp]-[adenosine deaminase]-COOH;

NH$_2$-[napDNAbp]-[NLS]-[adenosine deaminase]-COOH;

NH$_2$-[napDNAbp]-[adenosine deaminase]-[NLS]-COOH;

In some embodiments, the fusion proteins provided herein do not comprise a linker. In some embodiments, a linker is present between one or more of the domains or proteins (e.g., adenosine deaminase, napDNAbp, and/or NLS). In some embodiments, the "-" used in the general architecture above indicates the presence of an optional linker.

Fusion proteins comprising an adenosine deaminase, a napDNAbp, and an inhibitor of base repair (IBR).

NH$_2$-[IBR]-[adenosine deaminase]-[napDNAbp]-COOH;

NH$_2$-[adenosine deaminase]-[IBR]-[napDNAbp]-COOH;

NH$_2$-[adenosine deaminase]-[napDNAbp]-[IBR]-COOH;

NH$_2$-[IBR]-[napDNAbp]-[adenosine deaminase]-COOH;

NH$_2$-[napDNAbp]-[IBR]-[adenosine deaminase]-COOH;

NH$_2$-[napDNAbp]-[adenosine deaminase]-[IBR]-COOH;

In some embodiments, the fusion proteins provided herein do not comprise a linker. In some embodiments, a linker is present between one or more of the domains or proteins (e.g., adenosine deaminase, napDNAbp, and/or IBR). In some embodiments, the "-" used in the general architecture above indicates the presence of an optional linker.

Fusion proteins comprising an adenosine deaminase, a napDNAbp, an inhibitor of base repair (IBR) and a NLS.

NH$_2$-[IBR]-[NLS]-[adenosine deaminase]-[napDNAbp]-COOH;

NH$_2$-[NLS]-[IBR]-[adenosine deaminase]-[napDNAbp]-COOH;

NH$_2$-[NLS]-[adenosine deaminase]-[IBR]-[napDNAbp]-COOH;

NH$_2$-[NLS]-[adenosine deaminase]-[napDNAbp]-[IBR]-COOH;

NH$_2$-[IBR]-[adenosine deaminase]-[NLS]-[napDNAbp]-COOH;

NH$_2$-[adenosine deaminase]-[IBR]-[NLS]-[napDNAbp]-COOH;

NH$_2$-[adenosine deaminase]-[NLS]-[IBR]-[napDNAbp]-COOH;

NH$_2$-[adenosine deaminase]-[NLS]-[napDNAbp]-[IBR]-COOH;

NH$_2$-[IBR]-[adenosine deaminase]-[napDNAbp]-[NLS]-COOH;

NH$_2$-[adenosine deaminase]-[IBR]-[napDNAbp]-[NLS]-COOH;

NH$_2$-[adenosine deaminase]-[napDNAbp]-[IBR]-[NLS]-COOH;

NH$_2$-[adenosine deaminase]-[napDNAbp]-[NLS]-[IBR]-COOH;

NH$_2$-[IBR]-[NLS]-[napDNAbp]-[adenosine deaminase]-COOH;

NH₂-[NLS]-[IBR]-[napDNAbp]-[adenosine deaminase]-COOH;

NH₂-[NLS]-[napDNAbp]-[IBR]-[adenosine deaminase]-COOH;

NH₂-[NLS]-[napDNAbp]-[adenosine deaminase]-[IBR]-COOH;

NH₂-[IBR]-[napDNAbp]-[NLS]-[adenosine deaminase]-COOH;

NH₂-[napDNAbp]-[IBR]-[NLS]-[adenosine deaminase]-COOH;

NH₂-[napDNAbp]-[NLS]-[IBR]-[adenosine deaminase]-COOH;

NH₂-[napDNAbp]-[NLS]-[adenosine deaminase]-[IBR]-COOH;

NH₂-[IBR]-[napDNAbp]-[adenosine deaminase]-[NLS]-COOH;

NH₂-[napDNAbp]-[IBR]-[adenosine deaminase]-[NLS]-COOH;

NH₂-[napDNAbp]-[adenosine deaminase]-[IBR]-[NLS]-COOH;

NH₂-[napDNAbp]-[adenosine deaminase]-[NLS]-[IBR]-COOH;

In some embodiments, the fusion proteins provided herein do not comprise a linker. In some embodiments, a linker is present between one or more of the domains or proteins (e.g., adenosine deaminase, napDNAbp, NLS, and/or IBR). In some embodiments, the "-" used in the general architecture above indicates the presence of an optional linker.

Some aspects of the disclosure provide fusion proteins that comprise a nucleic acid programmable DNA binding protein (napDNAbp) and at least two adenosine deaminase domains. Without wishing to be bound by any particular theory, dimerization of adenosine deaminases (e.g., in cis or in trans) may improve the ability (e.g., efficiency) of the fusion protein to modify a nucleic acid base, for example to deaminate adenine. In some embodiments, any of the fusion proteins may comprise 2, 3, 4 or 5 adenosine deaminase domains. In some embodiments, any of the fusion proteins provided herein comprise two adenosine deaminases. In some embodiments, any of the fusion proteins provided herein contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. As one example, the fusion protein may comprise a first adenosine deaminase and a second adenosine deaminase that both comprise the amino acid sequence of SEQ ID NO: 72, which contains a A106V, D108N, D147Y, and E155V mutation from ecTadA (SEQ ID NO: 1). As another example, the fusion protein may comprise a first adenosine deaminase domain that comprises the amino acid sequence of SEQ ID NO: 72, which contains a A106V, D108N, D147Y, and E155V mutation from ecTadA (SEQ ID NO: 1), and a second adenosine deaminase that comprises the amino acid sequence of SEQ ID NO: 421, which contains a L84F, A106V, D108N, H123Y, D147Y, E155V, and I156F mutation from ecTadA (SEQ ID NO: 1).

In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker. In some embodiments, the linker is any of the linkers provided herein, for example, any of the linkers described in the "Linkers" section. In some embodiments, the linker comprises the amino acid sequence of any one of SEQ ID NOs: 10, 37-40, 384-386, or 685-688. In some embodiments, the first adenosine deaminase is the same as the second adenosine deaminase. In some embodiments, the first adenosine deaminase and the second adenosine deaminase are any of the adenosine deaminases described herein. In some embodiments, the first adenosine deaminase and the second adenosine deaminase are different. In some embodiments, the first adenosine deaminase is any of the adenosine deaminases provided herein. In some embodiments, the second adenosine deaminase is any of the adenosine deaminases provided herein but is not identical to the first adenosine deaminase. In some embodiments, the first adenosine deaminase is an ecTadA adenosine deaminase. In some embodiments, the first adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the first adenosine deaminase comprises the amino acid sequence of SEQ ID NO: 1. In some embodiments, the second adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 1, 64-84, 420-437, 672-684, or to any of the adenosine deaminases provided herein. In some embodiments, the second adenosine deaminase comprises the amino acid sequence of SEQ ID NO: 1. In some embodiments, the first adenosine deaminase and the second adenosine deaminase of the fusion protein comprise the mutations in ecTadA (SEQ ID NO: 1), or corresponding mutations in another adenosine deaminase, as shown in any one of the constructs provided in Table 4 (e.g., pNMG-371, pNMG-477, pNMG-576, pNMG-586, and pNMG-616). In some embodiments, the fusion protein comprises the two adenosine deaminases (e.g., a first adenosine deaminase and a second adenosine deaminase) of any one of the constructs (e.g., pNMG-371, pNMG-477, pNMG-576, pNMG-586, and pNMG-616) in Table 4.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), NH₂ is the N-terminus of the fusion protein, and COOH is the C-terminus of the fusion protein.

Fusion proteins comprising a first adenosine deaminase, a second adenosine deaminase, and a napDNAbp.

NH$_2$-[first adenosine deaminase]-[second adenosine deaminase]-[napDNAbp]-COOH;

NH$_2$-[first adenosine deaminase]-[napDNAbp]-[second adenosine deaminase]-COOH;

NH$_2$-[napDNAbp]-[first adenosine deaminase]-[second adenosine deaminase]-COOH;

NH$_2$-[second adenosine deaminase]-[first adenosine deaminase]-[napDNAbp]-COOH;

NH$_2$-[second adenosine deaminase]-[napDNAbp]-[first adenosine deaminase]-COOH;

NH$_2$-[napDNAbp]-[second adenosine deaminase]-[first adenosine deaminase]-COOH;

In some embodiments, the fusion proteins provided herein do not comprise a linker. In some embodiments, a linker is present between one or more of the domains or proteins (e.g., first adenosine deaminase, second adenosine deaminase, and/or napDNAbp). In some embodiments, the "-" used in the general architecture above indicates the presence of an optional linker.

Fusion proteins comprising a first adenosine deaminase, a second adenosine deaminase, a napDNAbp, and an NLS.

NH$_2$-[NLS]-[first adenosine deaminase]-[second adenosine deaminase]-[napDNAbp]-COOH;

NH$_2$-[first adenosine deaminase]-[NLS]-[second adenosine deaminase]-[napDNAbp]-COOH;

NH$_2$-[first adenosine deaminase]-[second adenosine deaminase]-[NLS]-[napDNAbp]-COOH;

NH$_2$-[first adenosine deaminase]-[second adenosine deaminase]-[napDNAbp]-[NLS]-COOH;

NH$_2$-[NLS]-[first adenosine deaminase]-[napDNAbp]-[second adenosine deaminase]-COOH;

NH$_2$-[first adenosine deaminase]-[NLS]-[napDNAbp]-[second adenosine deaminase]-COOH;

NH$_2$-[first adenosine deaminase]-[napDNAbp]-[NLS]-[second adenosine deaminase]-COOH;

NH$_2$-[first adenosine deaminase]-[napDNAbp]-[second adenosine deaminase]-[NLS]-COOH;

NH$_2$-[NLS]-[napDNAbp]-[first adenosine deaminase]-[second adenosine deaminase]-COOH;

NH$_2$-[napDNAbp]-[NLS]-[first adenosine deaminase]-[second adenosine deaminase]-COOH;

NH$_2$-[napDNAbp]-[first adenosine deaminase]-[NLS]-[second adenosine deaminase]-COOH;

NH$_2$-[napDNAbp]-[first adenosine deaminase]-[second adenosine deaminase]-[NLS]-COOH;

NH$_2$-[NLS]-[second adenosine deaminase]-[first adenosine deaminase]-[napDNAbp]-COOH;

NH$_2$-[second adenosine deaminase]-[NLS]-[first adenosine deaminase]-[napDNAbp]-COOH;

NH$_2$-[second adenosine deaminase]-[first adenosine deaminase]-[NLS]-[napDNAbp]-COOH;

NH$_2$-[second adenosine deaminase]-[first adenosine deaminase]-[napDNAbp]-[NLS]-COOH;

NH$_2$-[NLS]-[second adenosine deaminase]-[napDNAbp]-[first adenosine deaminase]-COOH;

NH$_2$-[second adenosine deaminase]-[NLS]-[napDNAbp]-[first adenosine deaminase]-COOH;

NH$_2$-[second adenosine deaminase]-[napDNAbp]-[NLS]-[first adenosine deaminase]-COOH;

NH$_2$-[second adenosine deaminase]-[napDNAbp]-[first adenosine deaminase]-[NLS]-COOH;

NH$_2$-[NLS]-[napDNAbp]-[second adenosine deaminase]-[first adenosine deaminase]-COOH;

NH$_2$-[napDNAbp]-[NLS]-[second adenosine deaminase]-[first adenosine deaminase]-COOH;

NH$_2$-[napDNAbp]-[second adenosine deaminase]-[NLS]-[first adenosine deaminase]-COOH;

NH$_2$-[napDNAbp]-[second adenosine deaminase]-[first adenosine deaminase]-[NLS]-COOH;

In some embodiments, the fusion proteins provided herein do not comprise a linker. In some embodiments, a linker is present between one or more of the domains or proteins (e.g., first adenosine deaminase, second adenosine deaminase, napDNAbp, and/or NLS). In some embodiments, the "-" used in the general architecture above indicates the presence of an optional linker.

It should be appreciated that the fusion proteins of the present disclosure may comprise one or more additional features. For example, in some embodiments, the fusion protein may comprise cytoplasmic localization sequences, export sequences, such as nuclear export sequences, or other localization sequences, as well as sequence tags that are useful for solubilization, purification, or detection of the fusion proteins. Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Linkers

In certain embodiments, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 10), which may also be referred to as the XTEN linker. In some embodiments, a linker comprises the amino acid sequence SGGS (SEQ ID NO: 37). In some embodiments, a linker comprises (SGGS)$_n$(SEQ ID NO: 37), (GGGS)n (SEQ ID NO: 38), (GGGGS)n (SEQ ID NO: 39), (G)n, (EAAAK)n (SEQ ID NO: 40), (GGS)n, SGSETPGTSESATPES (SEQ ID NO: 10), or (XP)n motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 10), and SGGS (SEQ ID NO: 37). In some embodiments, a linker comprises (SEQ ID NO: 384)
SGGSSGSETPGTSESATPESSGGS.

In some embodiments, a linker comprises (SEQ ID NO: 385)
SGGSSGGSSGSETPGTSESATPESSGGSSGGS.

In some embodiments, a linker comprises (SEQ ID NO: 386)
GGSGGSPGSPAGSPTSTEEGTSESATPESGPGTSTEPSEGSAPGSPAGSP

TSTEEGTSTEPSEGSAPGTSTEPSEGSAPGTSESATPESGPGSEPATSGG

SGGS

In some embodiments, the linker is 24 amino acids in length. In some embodiments, the linker comprises the amino acid sequence (SEQ ID NO: 685)
SGGSSGGSSGSETPGTSESATPES.

In some embodiments, the linker is 40 amino acids in length. In some embodiments, the linker comprises the amino acid sequence (SEQ ID NO: 686)
SGGSSGGSSGSETPGTSESATPESSGGSSGGSSGGSSGGS.

In some embodiments, the linker is 64 amino acids in length. In some embodiments, the linker comprises the amino acid sequence (SEQ ID NO: 687)
SGGSSGGSSGSETPGTSESATPESSGGSSGGSSGGSSGGSSGSETPGTSE

SATPESSGGSSGGS.

In some embodiments, the linker is 92 amino acids in length. In some embodiments, the linker comprises the amino acid sequence (SEQ ID NO: 688)
PGSPAGSPTSTEEGTSESATPESGPGTSTEPSEGSAPGSPAGSPTSTEEG

TSTEPSEGSAPGTSTEPSEGSAPGTSESATPESGPGSEPATS.

It should be appreciated that any of the linkers provided herein may be used to link a first adenosine deaminase and a second adenosine deaminase; an adenosine deaminase (e.g., a first or a second adenosine deaminase) and a napDNAbp; a napDNAbp and an NLS; or an adenosine deaminase (e.g., a first or a second adenosine deaminase) and an NLS.

In some embodiments, any of the fusion proteins provided herein, comprise an adenosine deaminase and a napDNAbp that are fused to each other via a linker. In some embodiments, any of the fusion proteins provided herein, comprise a first adenosine deaminase and a second adenosine deaminase that are fused to each other via a linker. In some embodiments, any of the fusion proteins provided herein, comprise an NLS, which may be fused to an adenosine deaminase (e.g., a first and/or a second adenosine deaminase), a nucleic acid programmable DNA binding protein (napDNAbp), and or an inhibitor of base repair (IBR). Various linker lengths and flexibilities between an adenosine deaminase (e.g., an engineered ecTadA) and a napDNAbp (e.g., a Cas9 domain), and/or between a first adenosine deaminase and a second adenosine deaminase can be employed (e.g., ranging from very flexible linkers of the form (GGGGS)n (SEQ ID NO: 38), (GGGGS)n (SEQ ID NO: 39), and (G)n to more rigid linkers of the form (EAAAK)n (SEQ ID NO: 40), (SGGS)n (SEQ ID NO: 37), SGSETPGTSESATPES (SEQ ID NO: 10) (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP).) in order to achieve the optimal length for deaminase activity for the specific application. In some embodiments, n is 1, 2, 3, 4, 5, 6, 7, 8, 9, 10, 11, 12, 13, 14, or 15. In some embodiments, the linker comprises a (GGS)$_n$ motif, wherein n is 1, 3, or 7. In some embodiments, the adenosine deaminase and the napDNAbp, and/or the first adenosine deaminase and the second adenosine deaminase of any of the fusion proteins provided herein are fused via a linker comprising the amino acid sequence

SGSETPGTSESATPES, (SEQ ID NO: 10)

SGGS, (SEQ ID NO: 37)

SGGSSGSETPGTSESATPESSGGS, (SEQ ID NO: 384)

SGGSSGGSSGSETPGTSESATPESSGGSSGGS, (SEQ ID NO: 385)

or

GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS. (SEQ ID NO: 386)

In some embodiments, the linker is 24 amino acids in length. In some embodiments, the linker comprises the amino acid sequence SGGSSGGSSGSETPGTSESATPES (SEQ ID NO: 685). In some embodiments, the linker is 40 amino acids in length. In some embodiments, the linker comprises the amino acid sequence

SGGSSGGSSGSETPGTSESATPESSGGSSGGSSGGSSGGS. (SEQ ID NO: 686)

In some embodiments, the linker is 64 amino acids in length. In some embodiments, the linker comprises the amino acid sequence SGGSSGGSSGSETPGTSESATPESSGGSSGGSSGGSSGGSSGSETPGTSESATPESSGGSSGGS. (SEQ ID NO: 687)

In some embodiments, the linker is 92 amino acids in length. In some embodiments, the linker comprises the amino acid sequence PGSPAGSPTSTEEGTSESATPESGPGTSTEPSEGSAPGSPAGSPTSTEEGTSTEPSEGSAPGTSTEPSEGSAPGTSESATPESGPGSEPATS. (SEQ ID NO: 688)

Some aspects of the disclosure provide fusion proteins comprising a Cas9 domain and an adenosine deaminase. Exemplary fusion proteins include, without limitation, the following fusion proteins (for the purposes of clarity, the adenosine deaminase domain is shown in Bold; mutations of the ecTadA deaminase domain are shown in Bold underlining; the XTEN linker is shown in italics; the UGI/AAG/EndoV domains are shown in Bold italics; and NLS is shown in underlined italics):

ecTadA(wt)-XTEN-nCas9-NLS: (SEQ ID NO: 11)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNEDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTEDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*PKKKRKV* ecTadA(D108N)-XTEN-nCas9-NLS: (mammalian construct, active on DNA, A to G editing):

(SEQ ID NO: 12)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARNAKTGAAGSLMDVLHHPGMNHRVEITEGILADECAALLSDFFRMRRQEIKA
QKKAQSSTD*SGSETPGTSESATPES*DKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*PKKKRKV*

-continued ecTadA(D108G)-XTEN-nCas9-NLS: (mammalian construct, active on DNA, A to G editing):

(SEQ ID NO: 13)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGGAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS_PKKKRKV_ ecTadA(D108V)-XTEN-nCas9-NLS: (mammalian construct, active on DNA, A to G editing):

(SEQ ID NO: 14)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*PKKKRKV* ecTadA(D108N)-XTEN-nCas9-UGI-NLS (BE3 analog of A to G editor):

(SEQ ID NO: 15)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

-continued

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDEL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS PKKKRKV ecTadA(D108G)-XTEN-nCas9-UGI-NLS (BE3 analog of A to G editor): (SEQ ID NQ: 16)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNEDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRENASLGTYHDLLKIIKDKDFLDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS PKKKRKV ecTadA(D108V)-XTEN-nCas9-UGI-NLS (BE3 analog of A to G editor): (SEQ ID NQ: 17)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNEDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGSTNLSDIIEKETGKQLVIQESILMLPEEVEEVIGNKPESDILVHT

AYDESTDENVMLLTSDAPEYKPWALVIQDSNGENKIKMLSGGS PKKKRKV ecTadA(D108N)-XTEN-dCas9-UGI-NLS (mammalian cells, BE2 analog of A to G editor):

(SEQ ID NO: 18)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNEDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTEDNGSIPHQIHLGELHAILRRQEDFYPFLKDNREKI

EKILTFRIPYYVGPLARGNSRFAWMTRKSEETITPWNFEEVVDKGASAQSFIERMTNF

-continued

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS PKKKRKV ecTadA(D108G)-XTEN-dCas9-UGI-NLS (mammalian cells, BE2 analog of A to G editor):
(SEQ ID NO: 19)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNEDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTEDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLEDDKVMKQLKRRRYTGWGRLSRKLINGI

RDKQSGKTILDELKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

-continued

TGEIVWDKGRDFATVRKVLSMPQVNIVKKTEVQTGGESKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS*PKKKRKV* ecTadA(D108V)-XTEN-dCas9-UGI-NLS (mammalian cells, BE2 analog of A to G editor):

(SEQ ID NO: 20)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARVAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*TNLSDIIEKETGKQLVIQESILMLPEEVEEVIGNKPESDILVHT*

*AYDESTDENVMLLTSDAPEYKPWALVIQDSNGENKIKML*SGGS*PKKKRKV* ecTadA(D108N)-XTEN-nCas9-AAG(E125Q)-NLS - cat. alkyladenosine glycosylase:

(SEQ ID NO: 21)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTDSGSETPGTSESATPESDKKYSIGLAIGTNSVGWAVITDEYKVPSKKFKV
LGNTDRHSIKKNLIGALLEDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNEDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDELDNEEN
EDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*KGHLTRLGLEFFDQPAVPLARAFLGQVLVRRLPNGTELRGRI*
*VETQAYLGPEDEAAHSRGGRQTPRNRGMFMKPGTLYVYIIYGMYFCMNISSQGDGA*
*CVLLRALEPLEGLETMRQLRSTLRKGTASRVLKDRELCSGPSKLCQALAINKSFDQR*
*DLAQDEAVWLERGPLEPSEPAVVAAARVGVHAGEWARKPLRFYVRGSPWVSVVD*
*RVAEQDTQA*SGGSPKKKRKV ecTadA(D108G)-XTEN-nCas9-AAG(E125Q)-NLS - cat. alkyladenosine glycosylase:

(SEQ ID NO: 22)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARGAKTGAAGSLMDVLHHPGMNHRVEITEGILADECAALLSDFFRMRRQEIKA
QKKAQSSTDSGSETPGTSESATPESDKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLEDDKVMKQLRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*KGHLTRLGLEFFDQPAVPLARAFLGQVLVRRLPNGTELRGRI*
*VETQAYLGPEDEAAHSRGGRQTPRNRGMFMKPGTLYVYIIYGMYFCMNISSQGDGA*
*CVLLRALEPLEGLETMRQLRSTLRKGTASRVLKDRELCSGPSKLCQALAINKSFDQR*
*DLAQDEAVWLERGPLEPSEPAVVAAARVGVHAGEWARKPLRFYVRGSPWVSVVD*
*RVAEQDTQA*SGGS<u>PKKKRKV</u> ecTadA(D108V)-XTEN-nCas9-AAG(E125Q)-NLS - cat. alkyladenosine glycosylase:
(SEQ ID NO: 23)
MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARV<u>A</u>KTGAAGSLMDVLHHPGMNHRVEITEGILADECAALLSDFFRMRRQEIKA
QKKAQSSTD*SGSETPGTSESATPES*DKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLEDDKVMKQLRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH -continued IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDEL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDSGGS*KGHLTRLGLEFFDQPAVPLARAFLGQVLVRRLPNGTELRGRI*
*VETQAYLGPEDEAAHSRGGRQTPRNRGMFMKPGTLYVYIIYGMYFCMNISSQGDGA*
*CVLLRALEPLEGLETMRQLRSTLRKGTASRVLKDRELCSGPSKLCQALAINKSFDQR*
*DLAQDEAVWLERGPLEPSEPAVVAAARVGVGHAGEWARKPLRFYVRGSPWVSVVD*
*RVAEQDTQAS*GGSPKKKRKV ecTadA(D108N)-XTEN-nCas9-EndoV(D35A)-NLS: contains cat. endonuclease V: (SEQ ID NO: 24)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARNAKTGAAGSLMDVLHHPGMNHRVEITEGILADECAALLSDFFRMRRQEIKA
QKKAQSSTD*SGSETPGTSESATPES*DKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNEDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLEDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDSGGS*DLASLRAQQIELASSVIREDRLDKDPPDLIAGAAVGFEQGGEV*

*TRAAMVLLKYPSLELVEYKVARIATTMPYIPGFLSFREYPALLAAWEMLSQKPDLVF*

*VDGHGISHPRRLGVASHFGLLVDVPTIGVAKKRLCGKFEPLSSEPGALAPLMDKGEQ*

*LAWVWRSKARCNPLFIATGHRVSVDSALAWVQRCMKGYRLPEPTRWADAVASERPA*

*FVRYTANQP*SGGS PKKKRKV ecTadA(D108G)-XTEN-nCas9-EndoV (D35A)-NLS: contains cat. endonuclease V:

(SEQ ID NO: 25)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARGAKTGAAGSLMDVLHHPGMNHRVEITEGILADECAALLSDFFRMRRQEIKA

QKKAQSSTD*SGSETPGTSESATPES*DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLFDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYEDTTIDRKRYTSTKEVLDATLIHQSITGLYE

TRIDLSQLGGDSGGS*DLASLRAQQIELASSVIREDRLDKDPPDLIAGAAVGFEQGGEV*

*TRAAMVLLKYPSLELVEYKVARIATTMPYIPGFLSFREYPALLAAWEMLSQKPDLVF*

*VDGHGISHPRRLGVASHFGLLVDVPTIGVAKKRLCGKFEPLSSEPGALAPLMDKGEQ*

*LAWVWRSKARCNPLFIATGHRVSVDSALAWVQRCMKGYRLPEPTRWADAVASERPA*

*FVRYTANQP*SGGS PKKKRKV ecTadA(D108V)-XTEN-nCas9-EndoV(D35A)-NLS: contains cat. endonuclease V:

-continued (SEQ ID NO: 26)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARV̲AKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTEDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYEDTTIDRKRYTSTKEVLDATLIHQSITGLYE

TRIDLSQLGGDSGGS_DLASLRAQQIELASSVIREDRLDKDPPDLIAGAAVGFEQGGEV_

_TRAAMVLLKYPSLELVEYKVARIATTMPYIPGFLSFREYPALLAAWEMLSQKPDLVF_

_VDGHGISHPRRLGVASHFGLLVDVPTIGVAKKRLCGKFEPLSSEPGALAPLMDKGEQ_

_LAWVWRSKARCNPLFIATGHRVSVDSALAWVQRCMKGYRLPEPTRWADAVASERPA_

_FVRYTANQP_SGGS_PKKKRKV_

Variant resulting from first round of evolution (in bacteria)
ecTadA(H8Y_D108N_N127S)-XTEN-dCas9:

(SEQ ID NO: 27)

MSEVEFSY̲EYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARN̲AKTGAAGSLMDVLHHPGMS̲HRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

-continued

KAILSARLSKSRRLENLIAQLPGEKKNGLFGNLIALSLGLTPNFKSNEDLAEDAKLQLS

KDTYDDDLDNLLAQIGDQYADFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD

Enriched variants from second round of evolution (in bacteria) ecTadA
(H8Y_D108N_N127S_E155X)-XTEN-dCas9; X = D, G or V:

(SEQ ID NO: 28)

MSEVEFSYEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMSHRVEITEGILADECAALLSDFFRMRRQXIKA

QKKAQSSTD$SGSETPGTSESATPES$DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDELDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDA

-continued

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGFSKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGD ecTadA*-XTEN-nCas9-GGS-DNA repair inhibitor-GGS-NLS (Inhibitor = UGI, AAG*E125Q or Endo V*D35A)
pNMG-160: ecTadA(D108N)-XTEN-nCas9-GGS-AAG*(E125Q)-GGS-NLS (SEQ ID NO: 387)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARNAKTGAAGSLMDVLHHPGMNHRVEITEGILADECAALLSDFFRMRRQEIKA

QKKAQSSTD_SGSETPGTSESATPES_DKKYSIGLAIGTNSVGWAVITDEYKVPSKKFKV

LGNTDRHSIKKNLIGALLFDSGETAEATRLKRTARRRYTRRKNRICYLQEIFSNEMAK

VDDSFFHRLEESFLVEEDKKHERHPIFGNIVDEVAYHEKYPTIYHLRKKLVDSTDKAD

LRLIYLALAHMIKFRGHFLIEGDLNPDNSDVDKLFIQLVQTYNQLFEENPINASGVDA

KAILSARLSKSRRLENLIAQLPGEKKNGLFGNLIALSLGLTPNFKSNFDLAEDAKLQLS

KDTYDDDLDNLLAQIGDQYADLFLAAKNLSDAILLSDILRVNTEITKAPLSASMIKRY

DEHHQDLTLLKALVRQQLPEKYKEIFFDQSKNGYAGYIDGGASQEEFYKFIKPILEK

MDGTEELLVKLNREDLLRKQRTFDNGSIPHQIHLGELHAILRRQEDFYPFLKDNREKI

EKILTFRIPYYVGPLARGNSRFAWMTRKSEETITPWNFEEVVDKGASAQSFIERMTNF

DKNLPNEKVLPKHSLLYEYFTVYNELTKVKYVTEGMRKPAFLSGEQKKAIVDLLFK

TNRKVTVKQLKEDYFKKIECFDSVEISGVEDRFNASLGTYHDLLKIIKDKDFLDNEEN

EDILEDIVLTLTLFEDREMIEERLKTYAHLEDDKVMKQLKRRRYTGWGRLSRKLINGI

RDKQSGKTILDFLKSDGFANRNFMQLIHDDSLTFKEDIQKAQVSGQGDSLHEHIANL

AGSPAIKKGILQTVKVVDELVKVMGRHKPENIVIEMARENQTTQKGQKNSRERMKR

IEEGIKELGSQILKEHPVENTQLQNEKLYLYYLQNGRDMYVDQELDINRLSDYDVDH

IVPQSFLKDDSIDNKVLTRSDKNRGKSDNVPSEEVVKKMKNYWRQLLNAKLITQRK

FDNLTKAERGGLSELDKAGFIKRQLVETRQITKHVAQILDSRMNTKYDENDKLIREV

KVITLKSKLVSDFRKDFQFYKVREINNYHHAHDAYLNAVVGTALIKKYPKLESEFVY

GDYKVYDVRKMIAKSEQEIGKATAKYFFYSNIMNFFKTEITLANGEIRKRPLIETNGE

TGEIVWDKGRDFATVRKVLSMPQVNIVKKTEVQTGGESKESILPKRNSDKLIARKKD

WDPKKYGGFDSPTVAYSVLVVAKVEKGKSKKLKSVKELLGITIMERSSFEKNPIDFL

EAKGYKEVKKDLIIKLPKYSLFELENGRKRMLASAGELQKGNELALPSKYVNFLYLA

SHYEKLKGSPEDNEQKQLFVEQHKHYLDEIIEQISEFSKRVILADANLDKVLSAYNKH

RDKPIREQAENIIHLFTLTNLGAPAAFKYFDTTIDRKRYTSTKEVLDATLIHQSITGLYE

TRIDLSQLGGDGGS_KGHLTRLGLEFFDQPAVPLARAFLGQVLVRRLPNGTELRGRIV_

```
-continued
ETQAYLGPEDEAAHSRGGRQTPRNRGMFMKPGTLYVYIITYGMYFCMNISSQGDGAC
VLLRALEPLEGLETMRQLRSTLRKGTASRVLKDRELCSGPSKLCQALAINKSFDQRD
LAQDEAVWLERGPLEPSEPAVVAAARVGVGHAGEWARKPLRFYVRGSPWVSVVDR
VAEQDTQAGGSPKKKRKV pNMG-161: ecTadA(D108N)-XTEN-nCas9-GGS-EndoV*(D35A)-GGS-NLS
                                                                    (SEQ ID NO: 388)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARNAKTGAAGSLMDVLHHPGMNHRVEITEGILADECAALLSDFFRMRRQEIKA
QKKAQSSTDSGSETPGTSESATPESDKKYSIGLAIGTNSVGWAVITDEYKVPSKKFKV
LGNTDRHSIKKNLIGALLFDSGETAEATRLKRTARRRYTRRKNRICYLQEIFSNEMAK
VDDSFFHRLEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENPINASGVDA
KAILSARLSKSRRLENLIAQLPGEKKNGLFGNLIALSLGLTPNFKSNFDLAEDAKLQLS
KDTYDDDLDNLLAQIGDQYADLFLAAKNLSDAILLSDILRVNTEITKAPLSASMIKRY
DEHHQDLTLLKALVRQQLPEKYKEIFFDQSKNGYAGYIDGGASQEEFYKFIKPILEK
MDGTEELLVKLNREDLLRKQRTFDNGSIPHQIHLGELHAILRRQEDFYPFLKDNREKI
EKILTFRIPYYVGPLARGNSRFAWMTRKSEETITPWNFEEVVDKGASAQSFIERMTNF
DKNLPNEKVLPKHSLLYEYFTVYNELTKVKYVTEGMRKPAFLSGEQKKAIVDLLFK
TNRKVTVKQLKEDYFKKIECFDSVEISGVEDRFNASLGTYHDLLKIIKDKDFLDNEEN
EDILEDIVLTLTLFEDREMIEERLKTYAHLFDDKVMKQLKRRRYTGWGRLSRKLINGI
RDKQSGKTILDFLKSDGFANRNFMQLIHDDSLTFKEDIQKAQVSGQGDSLHEHIANL
AGSPAIKKGILQTVKVVDELVKVMGRHKPENIVIEMARENQTTQKGQKNSRERMKR
IEEGIKELGSQILKEHPVENTQLQNEKLYLYYLQNGRDMYVDQELDINRLSDYDVDH
IVPQSFLKDDSIDNKVLTRSDKNRGKSDNVPSEEVVKKMKNYWRQLLNAKLITQRK
FDNLTKAERGGLSELDKAGFIKRQLVETRQITKHVAQILDSRMNTKYDENDKLIREV
KVITLKSKLVSDFRKDFQFYKVREINNYHHAHDAYLNAVVGTALIKKYPKLESEFVY
GDYKVYDVRKMIAKSEQEIGKATAKYFFYSNIMNFFKTEITLANGEIRKRPLIETNGE
TGEIVWDKGRDFATVRKVLSMPQVNIVKKTEVQTGGFSKESILPKRNSDKLIARKKD
WDPKKYGGFDSPTVAYSVLVVAKVEKGKSKKLKSVKELLGITIMERSSFEKNPIDFL
EAKGYKEVKKDLIIKLPKYSLFELENGRKRMLASAGELQKGNELALPSKYVNFLYLA
SHYEKLKGSPEDNEQKQLFVEQHKHYLDEIIEQISEFSKRVILADANLDKVLSAYNKH
RDKPIREQAENIIHLFTLTNLGAPAAFKYFDTTIDRKRYTSTKEVLDATLIHQSITGLYE
TRIDLSQLGGDGGSDLASLRAQQIELASSVIREDRLDKDPPDLIAGAAVGFEQGGEVT
RAAMVLLKYPSLELVEYKVARIATTMPYIPGFLSFREYPALLAAWEMLSQKPDLVFV
DGHGISHPRRLGVASHFGLLVDVPTIGVAKKRLCGKFEPLSSEPGALAPLMDKGEQL
AWVWRSKARCNPLFIATGHRVSVDSALAWVQRCMKGYRLPEPTRWADAVASERPA
FVRYTANQPGGSPKKKRKV pNMG-371: ecTadA(L84F_A106V_D108N_H123Y_D147Y_E155V_I156F)-SGGS-
SGGS-XTEN-SGGS-SGGS-
ecTadA(L84F_A106V_D108N_H123Y_D147Y_E155V_I156F)-SGGS-SGGS-XTEN-
SGGS-SGGS-nCas9-SGGS-NLS
                                                                    (SEQ ID NO: 440)
SEVEFSHEYWMRHALTLAKRAWDEREVPVGAVLVHNNRVIGEGWNRPIGRHD
```

PTAHAEIMALRQGGLVMQNYRLIDATLYVTFEPCVMCAGAMIHSRIGRVVFGV

RNAKTGAAGSLMDVLHYPGMNHRVEITEGILADECAALLSYFFRMRRQVFKAQ

KKAQSSTD*SGGSSGGSSGSETPGTSESATPESSGGSSGGS*SEVEFSHEYWMRHALTL

AKRAWDEREVPVGAVLVHNNRVIGEGWNRPIGRHDPTAHAEIMALRQGGLVM

QNYRLIDATLYVTFEPCVMCAGAMIHSRIGRVVFGVRNAKTGAAGSLMDVLHY

PGMNHRVEITEGILADECAALLSYFFRMRRQVFKAQKKAQSSTD*SGGSSGGSSGS*

*ETPGTSESATPESSGGSSGGS*<u>DKKYSIGLAIGTNSVGWAVITDEYKVPSKKFKVLGNT</u>

<u>DRHSIKKNLIGALLFDSGETAEATRLKRTARRRYTRRKNRICYLQEIFSNEMAKVDDS</u>

<u>FFHRLEESFLVEEDKKHERHPIFGNIVDEVAYHEKYPTIYHLRKKLVDSTDKADLRLI</u>

<u>YLALAHMIKFRGHFLIEGDLNPDNSDVDKLFIQLVQTYNQLFEENPINASGVDAKAIL</u>

<u>SARLSKSRRLENLIAQLPGEKKNGLFGNLIALSLGLTPNFKSNFDLAEDAKLQLSKDT</u>

<u>YDDDLDNLLAQIGDQYADLFLAAKNLSDAILLSDILRVNTEITKAPLSASMIKRYDEH</u>

<u>HQDLTLLKALVRQQLPEKYKEIFFDQSKNGYAGYIDGGASQEEFYKFIKPILEKMDG</u>

<u>TEELLVKLNREDLLRKQRTFDNGSIPHQIHLGELHAILRRQEDFYPFLKDNREKIEKIL</u>

<u>TFRIPYYVGPLARGNSRFAWMTRKSEETITPWNFEEVVDKGASAQSFIERMTNEDKN</u>

<u>LPNEKVLPKHSLLYEYFTVYNELTKVKYVTEGMRKPAFLSGEQKKAIVDLLFKTNRK</u>

<u>VTVKQLKEDYFKKIECFDSVEISGVEDRFNASLGTYHDLLKIIKDKDFLDNEENEDILE</u>

<u>DIVLTLTLFEDREMIEERLKTYAHLEDDKVMKQLKRRRYTGWGRLSRKLINGIRDKQ</u>

<u>SGKTILDFLKSDGFANRNFMQLIHDDSLTFKEDIQKAQVSGQGDSLHEHIANLAGSPA</u>

<u>IKKGILQTVKVVDELVKVMGRHKPENIVIEMARENQTTQKGQKNSRERMKRIEEGIK</u>

<u>ELGSQILKEHPVENTQLQNEKLYLYYLQNGRDMYVDQELDINRLSDYDVDHIVPQSE</u>

<u>LKDDSIDNKVLTRSDKNRGKSDNVPSEEVVKKMKNYWRQLLNAKLITQRKFDNLTK</u>

<u>AERGGLSELDKAGFIKRQLVETRQITKHVAQILDSRMNTKYDENDKLIREVKVITLKS</u>

<u>KLVSDFRKDFQFYKVREINNYHHAHDAYLNAVVGTALIKKYPKLESEFVYGDYKVY</u>

<u>DVRKMIAKSEQEIGKATAKYFFYSNIMNFFKTEITLANGEIRKRPLIETNGETGEIVWD</u>

<u>KGRDFATVRKVLSMPQVNIVKKTEVQTGGFSKESILPKRNSDKLIARKKDWDPKKY</u>

<u>GGFDSPTVAYSVLVVAKVEKGKSKKLKSVKELLGITIMERSSFEKNPIDFLEAKGYKE</u>

<u>VKKDLIIKLPKYSLFELENGRKRMLASAGELQKGNELALPSKYVNFLYLASHYEKLK</u>

<u>GSPEDNEQKQLFVEQHKHYLDEIIEQISEFSKRVILADANLDKVLSAYNKHRDKPIRE</u>

<u>QAENIIHLFTLTNLGAPAAFKYEDTTIDRKRYTSTKEVLDATLIHQSITGLYETRIDLSQ</u>

<u>LGGD</u>SGGS*PKKKRKV* pNMG-616 amino acid sequence: ecTadA<sub>(wild type)</sub>-(SGGS)2-XTEN-(SGGS)2-ecTadA<sub>(W23L_H36L_P48A_R51L_L84F_A106V_D108N_H123Y_S146C_D147Y_R152P_E155V_I156F_K157N)</sub>-(SGGS)2-XTEN-(SGGS)2_nCas9_SGGS_NLS (SEQ ID NO: 691)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTD*SGGSSGGSS*

*GSETPGTSESATPESSGGSSGGS*<u>DKKYSIGLAIGTNSVGWAVITDEYKVPSKKFKVLGN</u>

-continued

TDRHSIKKNLIGALLFDSGETAEATRLKRTARRRYTRRKNRICYLQEIFSNEMAKVDD
SFFHRLEESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINASGVDAKAI
LSARLSKSRRLENLIAQLPGEKKNGLFGNLIALSLGLTPNFKSNEDLAEDAKLQLSKD
TYDDDLDNLLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKI
LTFRIPYYVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVDLLFKTNR
KVTVKQLKEDYFKKIECFDSVEISGVEDRFNASLGTYHDLLKIIKDKDFLDNEENEDI
LEDIVLTLTLFEDREMIEERLKTYAHLEDDKVMKQLKRRRYTGWGRLSRKLINGIRD
KQSGKTILDFLKSDGFANRNFMQLIHDDSLTFKEDIQKAQVSGQGDSLHEHIANLAG
SPAIKKGILQTVKVVDELVKVMGRHKPENIVIEMARENQTTQKGQKNSRERMKRIEE
GIKELGSQILKEHPVENTQLQNEKLYLYYLQNGRDMYVDQELDINRLSDYDVDHIVP
QSFLKDDSIDNKVLTRSDKNRGKSDNVPSEEVVKKMKNYWRQLLNAKLITQRKFDN
LTKAERGGLSELDKAGFIKRQLVETRQITKHVAQILDSRMNTKYDENDKLIREVKVIT
LKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAK
GYKEVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQSITGLYETRI
DLSQLGGDSGGS*PKKKRKV* pNMG-624 amino acid sequence: ecTadA<sub>(wild type)</sub>-32 a.a. linker-
ecTadA<sub>(W23R_H36L_P48A_R51L_L84F_A106V_D108N_H123Y_S146C_D147Y_R152P_E155V_I156F_K157N)</sub>-24 a.a.
linker_nCas9_SGGS_NLS (SEQ ID NO: 692)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMRRQEIKA
QKKAQSSTD_SGGSSGGSSGSETPGTSESATPESSGGSSGGS_SEVEFSHEYWMRHALTL
AKRARDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHY
PGMNHRVEITEGILADECAALLCYFFRMPRQVFNAQKKAQSSTD_SGGSSGGSSGS_
_ETPGTSESATPES_DKKYSIGLAIGTNSVGWAVITDEYKVPSKKFKVLGNTDRHSIKKNL
IGALLFDSGETAEATRLKRTARRRYTRRKNRICYLQEIFSNEMAKVDDSFFHRLEESF
LVEEDKKHERHPIFGNIVDEVAYHEKYPTIYHLRKKLVDSTDKADLRLIYLALAHMI
KFRGHFLIEGDLNPDNSDVDKLFIQLVQTYNQLFEENPINASGVDAKAILSARLSKSR
RLENLIAQLPGEKKNGLFGNLIALSLGLTPNFKSNFDLAEDAKLQLSKDTYDDDLDN
LLAQIGDQYADLFLAAKNLSDAILLSDILRVNTEITKAPLSASMIKRYDEHHQDLTLL
KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNEDKNLPNEKVLP

KHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTL

FEDREMIEERLKTYAHLEDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV* pNMG-476 amino acid sequence (evolution #3 hetero dimer, wt TadA + TadA evo #3 mutations): ecTadA(wild-type)-(SGGS)2-XTEN-(SGGS)2-ecTadA(L84F_A106V_D108N_H123Y_D147Y_E155V_I156F)-(SGGS)2-XTEN-(SGGS)2_nCas9_SGGS_NLS (SEQ ID NO: 693)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVHNNRVIGEGWNRPIGRHDPTAHAEIMALRQGGLV

MQNYRLIDATLYVTFEPCVMCAGAMIHSRIGRVVFGVRNAKTGAAGSLMDVLH

YPGMNHRVEITEGILADECAALLSYFFRMRRQVFKAQKKAQSSTDSGGSSGGSS

GSETPGTSESATPESSGGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNEDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLEDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-477 amino acid sequence: ecTadA$_{(wild-type)}$-(SGGS)2-XTEN-(SGGS)2-
ecTadA$_{(H36L\_R51L\_L84F\_A106V\_D108N\_H123Y\_S146C\_D147Y\_E155V\_I156F\_K157N)}$-(SGGS)2-XTEN-
(SGGS)2_nCas9_SGGS_NLS (SEQ ID NO: 694)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRPIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLEDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKEDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-558 amino acid sequence: ecTadA(wild-type)- 32 a.a. linker-
ecTadA(H36L_R51L_L84F_A106V_D108N_H123Y_S146C_D147Y_E155V_I156F_K157N) - 24 a.a.
linker_nCas9_SGGS_NLS (SEQ ID NO: 695)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS***SEVEFSHEYWMRHALTL

AKRAWDEREVPVGAVLVLNNRVIGEGWNRPIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMRRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTL

FEDREMIEERLKTYAHLFDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

*GS*PKKKRKV

-continued pNMG-576 amino acid sequence: ecTadA$_{(wild-type)}$-(SGGS)2-XTEN-(SGGS)2-
ecTadA$_{(H36L\_P48S\_R51L\_L84F\_A106V\_D108N\_H123Y\_S146C\_D147Y\_E155V\_I156F\_K157N)}$-(SGGS)2-XTEN-
(SGGS)2_nCas9_GGS_NLS (SEQ ID NO: 696)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRSIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNEDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-577 amino acid sequence: ecTadA$_{(wild-type)}$-(SGGS)2-XTEN-(SGGS)2-
ecTadA$_{(H36L\_P48S\_R51L\_L84F\_A106V\_D108N\_H123Y\_S146C\_A142N\_D147Y\_E155V\_I156F\_K157N)}$-(SGGS)2-
XTEN-(SGGS)2_nCas9_GGS_NLS (SEQ ID NO: 697)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRSIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNEDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDELDNEENEDI

LEDIVLTLTLFEDREMIEERLKTYAHLEDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-586 amino acid sequence: ecTadA*(wild-type)*-(SGGS)2-XTEN-(SGGS)2-ecTadA*(H36L_P48A_R51L_L84F_A106V_D108N_H123Y_S146C_D147Y_E155V_I156F_K157N)*-(SGGS)2-XTEN-(SGGS)2_nCas9_GGS_NLS (SEQ ID NO: 698)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRAWDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD
TYDDDLDNLLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKI
LTFRIPYYVGPLARGNSRFAWMTRKSEETITPWNFEEVVDKGASAQSFIERMTNEDK
NLPNEKVLPKHSLLYEYFTVYNELTKVKYVTEGMRKPAFLSGEQKKAIVDLLFKTNR
KVTVKQLKEDYFKKIECFDSVEISGVEDRFNASLGTYHDLLKIIKDKDFLDNEENEDI
LEDIVLTLTLFEDREMIEERLKTYAHLFDDKVMKQLKRRRYTGWGRLSRKLINGIRD
KQSGKTILDFLKSDGFANRNFMQLIHDDSLTFKEDIQKAQVSGQGDSLHEHIANLAG
SPAIKKGILQTVKVVDELVKVMGRHKPENIVIEMARENQTTQKGQKNSRERMKRIEE
GIKELGSQILKEHPVENTQLQNEKLYLYYLQNGRDMYVDQELDINRLSDYDVDHIVP
QSFLKDDSIDNKVLTRSDKNRGKSDNVPSEEVVKKMKNYWRQLLNAKLITQRKFDN
LTKAERGGLSELDKAGFIKRQLVETRQITKHVAQILDSRMNTKYDENDKLIREVKVIT
LKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAK
GYKEVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQSITGLYETRI
DLSQLGGDSGGS*PKKKRKV* pNMG-588 amino acid sequence: ecTadA$_{(wild-type)}$-(SGGS)2-XTEN-(SGGS)2-
ecTadA$_{(H36L\_P48A\_R51L\_L84F\_A106V\_D108N\_H123Y\_S146C\_A142N\_D147Y\_E155V\_I156F\_K157N)}$-
(SGGS)2-XTEN-(SGGS)2_nCas9_GGS_NLS (SEQ ID NO: 699)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMRRQEIKA
QKKAQSSTDSGGSSGGS*SGSETPGTSESATPESS*SGGSSGGSSEVEFSHEYWMRHALT
LAKRAWDEREVPVGAVLVLNNRVIGEGWNRAIGLHDPTAHAEIMALRQGGLV
MQNYRLIDATLYVTFEPCVMCAGAMIHSRIGRVVFGVRNAKTGAAGSLMDVLH
YPGMNHRVEITEGILADECNALLCYFFRMRRQVFNAQKKAQSSTDSGGSSGGS*S*
*GSETPGTSESATPESS*SGGSSGGSDKKYSIGLAIGTNSVGWAVITDEYKVPSKKFKVLGN
TDRHSIKKNLIGALLFDSGETAEATRLKRTARRRYTRRKNRICYLQEIFSNEMAKVDD
SFFHRLEESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINASGVDAKAI
LSARLSKSRRLENLIAQLPGEKKNGLFGNLIALSLGLTPNFKSNEDLAEDAKLQLSKD
TYDDDLDNLLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKI
LTFRIPYYVGPLARGNSRFAWMTRKSEETITPWNFEEVVDKGASAQSFIERMTNEDK
NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLEDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-620 amino acid sequence: ecTadA<sub>(wild-type)</sub>-(SGGS)2-XTEN-(SGGS)2-
ecTadA<sub>(W23R_H36L_P48A_R51L_L84F_A106V_D108N_H123Y_S146C_D147Y_R152P_E155V_I156F_K157N)</sub>-
(SGGS)2-XTEN-(SGGS)2_nCas9_GGS_NLS (SEQ ID NO: 700)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRARDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECAALLCYFFRMPRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNEDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLEDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

-continued

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-617 amino acid sequence: ecTadA(wild-type)-(SGGS)2-XTEN-(SGGS)2-
ecTadA(W23L_H36L_P48A_R51L_L84F_A106V_D108N_H123Y_A142A_S146C_D147Y_E155V_I156F_K157N)-
(SGGS)2-XTEN-(SGGS)2_nCas9_GGS_NLS (SEQ ID NO: 701)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMRRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLFDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-618 amino acid sequence: ecTadA(wild-type)-(SGGS)2-XTEN-(SGGS)2-
ecTadA(W23L_H36L_P48A_R51L_L84F_A106V_D108N_H123Y_A142A_S146C_D147Y_R152P_E155V_I156F_K157N)-
(SGGS)2-XTEN-(SGGS)2_nCas9_GGS_NLS (SEQ ID NO: 702)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTDSGGSSGGS*SGSETPGTSESATPESS*GGSSGGSSEVEFSHEYWMRHALT

LAKRALDEREVPVGAVLVLNNRVIGEGWNRAIGLHDPTAHAEIMALRQGGLV

MQNYRLIDATLYVTFEPCVMCAGAMIHSRIGRVVFGVRNAKTGAAGSLMDVLH

YPGMNHRVEITEGILADECNALLCYFFRMPRQVFNAQKKAQSSTDSGGSSGGS*S*

*GSETPGTSESATPESS*GGSSGGSDKKYSIGLAIGTNSVGWAVITDEYKVPSKKFKVLGN

TDRHSIKKNLIGALLFDSGETAEATRLKRTARRRYTRRKNRICYLQEIFSNEMAKVDD

SFFHRLEESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINASGVDAKAI

LSARLSKSRRLENLIAQLPGEKKNGLFGNLIALSLGLTPNFKSNFDLAEDAKLQLSKD

TYDDDLDNLLAQIGDQYADLFLAAKNLSDAILLSDILRVNTEITKAPLSASMIKRYDE

HHQDLTLLKALVRQQLPEKYKEIFFDQSKNGYAGYIDGGASQEEFYKFIKPILEKMD

GTEELLVKLNREDLLRKQRTFDNGSIPHQIHLGELHAILRRQEDFYPFLKDNREKIEKI

LTFRIPYYVGPLARGNSRFAWMTRKSEETITPWNFEEVVDKGASAQSFIERMTNFDK

NLPNEKVLPKHSLLYEYFTVYNELTKVKYVTEGMRKPAFLSGEQKKAIVDLLFKTNR

KVTVKQLKEDYFKKIECFDSVEISGVEDRFNASLGTYHDLLKIIKDKDFLDNEENEDI

LEDIVLTLTLFEDREMIEERLKTYAHLEDDKVMKQLKRRRYTGWGRLSRKLINGIRD

KQSGKTILDFLKSDGFANRNFMQLIHDDSLTFKEDIQKAQVSGQGDSLHEHIANLAG

SPAIKKGILQTVKVVDELVKVMGRHKPENIVIEMARENQTTQKGQKNSRERMKRIEE

GIKELGSQILKEHPVENTQLQNEKLYLYYLQNGRDMYVDQELDINRLSDYDVDHIVP

QSFLKDDSIDNKVLTRSDKNRGKSDNVPSEEVVKKMKNYWRQLLNAKLITQRKFDN

LTKAERGGLSELDKAGFIKRQLVETRQITKHVAQILDSRMNTKYDENDKLIREVKVIT

LKSKLVSDFRKDFQFYKVREINNYHHAHDAYLNAVVGTALIKKYPKLESEFVYGDY

KVYDVRKMIAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARKKDWDP

KKYGGFDSPTVAYSVLVVAKVEKGKSKKLKSVKELLGITIMERSSFEKNPIDFLEAK

GYKEVKKDLIIKLPKYSLFELENGRKRMLASAGELQKGNELALPSKYVNFLYLASHY

EKLKGSPEDNEQKQLFVEQHKHYLDEIIEQISEFSKRVILADANLDKVLSAYNKHRDK

PIREQAENIIHLFTLTNLGAPAAFKYFDTTIDRKRYTSTKEVLDATLIHQSITGLYETRI

DLSQLGGDSGGS*PKKKRKV* pNMG-620 amino acid sequence: ecTadA(wild-type)-(SGGS)2-XTEN-(SGGS)2-
ecTadA(W23R_H36L_P48A_R51L_L84F_A106V_D108N_H123Y_S146C_D147Y_R152P_E155V_I156F_K157N)-
(SGGS)2-XTEN-(SGGS)2_nCas9_GGS_NLS (SEQ ID NO: 703)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

-continued

QKKAQSSTDSGGSSGGS*SGSETPGTSESATPESS*GGSSGGSSEVEFSHEYWMRHALT
LAKRARDEREVPVGAVLVLNNRVIGEGWNRAIGLHDPTAHAEIMALRQGGLV
MQNYRLIDATLYVTFEPCVMCAGAMIHSRIGRVVFGVRNAKTGAAGSLMDVLH
YPGMNHRVEITEGILADECAALLCYFFRMPRQVFNAQKKAQSSTDSGGSSGGS*S*
*GSETPGTSESATPESS*GGSSGGSDKKYSIGLAIGTNSVGWAVITDEYKVPSKKFKVLGN
TDRHSIKKNLIGALLFDSGETAEATRLKRTARRRYTRRKNRICYLQEIFSNEMAKVDD
SFFHRLEESFLVEEDKKHERHPIFGNIVDEVAYHEKYPTIYHLRKKLVDSTDKADLRL
IYLALAHMIKFRGHFLIEGDLNPDNSDVDKLFIQLVQTYNQLFEENPINASGVDAKAI
LSARLSKSRRLENLIAQLPGEKKNGLFGNLIALSLGLTPNFKSNFDLAEDAKLQLSKD
TYDDDLDNLLAQIGDQYADLFLAAKNLSDAILLSDILRVNTEITKAPLSASMIKRYDE
HHQDLTLLKALVRQQLPEKYKEIFFDQSKNGYAGYIDGGASQEEFYKFIKPILEKMD
GTEELLVKLNREDLLRKQRTFDNGSIPHQIHLGELHAILRRQEDFYPFLKDNREKIEKI
LTFRIPYYVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVDLLFKTNR
KVTVKQLKEDYFKKIECFDSVEISGVEDRFNASLGTYHDLLKIIKDKDFLDNEENEDI
LEDIVLTLTLFEDREMIEERLKTYAHLFDDDKVMKQLKRRRYTGWGRLSRKLINGIRD
KQSGKTILDFLKSDGFANRNFMQLIHDDSLTFKEDIQKAQVSGQGDSLHEHIANLAG
SPAIKKGILQTVKVVDELVKVMGRHKPENIVIEMARENQTTQKGQKNSRERMKRIEE
GIKELGSQILKEHPVENTQLQNEKLYLYYLQNGRDMYVDQELDINRLSDYDVDHIVP
QSFLKDDSIDNKVLTRSDKNRGKSDNVPSEEVVKKMKNYWRQLLNAKLITQRKFDN
LTKAERGGLSELDKAGFIKRQLVETRQITKHVAQILDSRMNTKYDENDKLIREVKVIT
LKSKLVSDFRKDFQFYKVREINNYHHAHDAYLNAVVGTALIKKYPKLESEFVYGDY
KVYDVRKMIAKSEQEIGKATAKYFFYSNIMNFFKTEITLANGEIRKRPLIETNGETGEI
VWDKGRDFATVRKVLSMPQVNIVKKTEVQTGGFSKESILPKRNSDKLIARKKDWDP
KKYGGFDSPTVAYSVLVVAKVEKGKSKKLKSVKELLGITIMERSSFEKNPIDFLEAK
GYKEVKKDLIIKLPKYSLFELENGRKRMLASAGELQKGNELALPSKYVNFLYLASHY
EKLKGSPEDNEQKQLFVEQHKHYLDEIIEQISEFSKRVILADANLDKVLSAYNKHRDK
PIREQAENIIHLFETLTNLGAPAAFKYFDTTIDRKRYTSTKEVLDATLIHQSITGLYETRI
DLSQLGGDSGGS*PKKKRKV* pNMG-621 amino acid sequence: ecTadA(wild-type)- 32 a.a. linker-
ecTadA(H36L_P48A_R51L_L84F_A106V_D108N_H123Y_S146C_D147Y_R152P_E155V_I156F_K157N)- 24 a.a.
linker_nCas9_GGS_NLS (SEQ ID NO: 704)

MSEVEFSHEYWMRHALTLAKRAWDEREVPVGAVLVHNNRVIGEGWNRPIGRH
DPTAHAEIMALRQGGLVMQNYRLIDATLYVTLEPCVMCAGAMIHSRIGRVVFG
ARDAKTGAAGSLMDVLHHPGMNHRVEITEGILADECAALLSDFFRMRRQEIKA
QKKAQSSTDSGGSSGGS*SGSETPGTSESATPESS*GGSSGGSSEVEFSHEYWMRHALTL
AKRAWDEREVPVGAVLVLNNRVIGEGWNRAIGLHDPTAHAEIMALRQGGLVM
QNYRLIDATLYVTFEPCVMCAGAMIHSRIGRVVFGVRNAKTGAAGSLMDVLHY
PGMNHRVEITEGILADECAALLCYFFRMPRQVFNAQKKAQSSTDSGGSSGGSSGS
*ETPGTSESATPES*DKKYSIGLAIGTNSVGWAVITDEYKVPSKKFKVLGNTDRHSIKKNL
IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVEISGVEDRFNASLGTYHDLLKIIKDKDFLDNEENEDILEDIVLTLTL

FEDREMIEERLKTYAHLFDDKVMKQLRRRYTGWGRLSRKLINGIRDKQSGKTILDE

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGEDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV* pNMG-622 amino acid sequence: ecTadA*(wild-type)* - 32 a.a. linker-
ecTadA*(H36L_P48A_R51L_L84F_A106V_D108N_H123Y_A142N_S146C_D147Y_R152P_E155V_I156F_K157N)* - 24 a.a.
linker_nCas9_GGS_NLS (SEQ ID NO: 705)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALTL

AKRAWDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECNALLCYFFRMPRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLFDSGETAEATRLKRTARRRYTRRKNRICYLQEIFSNEMAKVDDSFFHRLEESF

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

-continued

KHSLLYEYFTVYNELTKVKYVTEGMRKPAFLSGEQKKAIVDLLFKTNRKVTVKQLK

EDYFKKIECFDSVEISGVEDRENASLGTYHDLLKIIKDKDFLDNEENEDILEDIVLTLTL

FEDREMIEERLKTYAHLEDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV* pNMG-623 amino acid sequence: ecTadA(wild-type) - 32 a.a. linker-
ecTadA(W23L_H36L_P48A_R51L_L84F_A106V_D108N_H123Y_S146C_D147Y_R152P_E155V_I156F_K157N) -
24 a.a. linker_nCas9_GGS_NLS (SEQ ID NO: 706)

MSEVEFSHEYWMRHALTLAKRAWDEREVPVGAVLVHNNRVIGEGWNRPIGRH

DPTAHAEIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGSSGGS*SEVEFSHEYWMRHALTL

AKRALDEREVPVGAVLVLNNRVIGEGWNRAIGLHDPTAHAEIMALRQGGLVM

QNYRLIDATLYVTFEPCVMCAGAMIHSRIGRVVFGVRNAKTGAAGSLMDVLHY

PGMNHRVEITEGILADECAALLCYFFRMPRQVFNAQKKAQSSTD*SGGSSGGSSGS*

*ETPGTSESATPES*DKKYSIGLAIGTNSVGWAVITDEYKVPSKKFKVLGNTDRHSIKKNL

IGALLEDSGETAEATRLKRTARRRYTRRKNRICYLQEIFSNEMAKVDDSFFHRLEESE

LVEEDKKHERHPIFGNIVDEVAYHEKYPTIYHLRKKLVDSTDKADLRLIYLALAHMI

KFRGHFLIEGDLNPDNSDVDKLFIQLVQTYNQLFEENPINASGVDAKAILSARLSKSR

RLENLIAQLPGEKKNGLFGNLIALSLGLTPNFKSNFDLAEDAKLQLSKDTYDDDLDN

LLAQIGDQYADLFLAAKNLSDAILLSDILRVNTEITKAPLSASMIKRYDEHHQDLTLL

KALVRQQLPEKYKEIFFDQSKNGYAGYIDGGASQEEFYKFIKPILEKMDGTEELLVKL

NREDLLRKQRTFDNGSIPHQIHLGELHAILRRQEDFYPFLKDNREKIEKILTFRIPYYV

GPLARGNSRFAWMTRKSEETITPWNFEEVVDKGASAQSFIERMTNFDKNLPNEKVLP

KHSLLYEYFTVYNELTKVKYVTEGMRKPAFLSGEQKKAIVDLLFKTNRKVTVKQLK

EDYFKKIECFDSVEISGVEDRENASLGTYHDLLKIIKDKDFLDNEENEDILEDIVLTLTL

FEDREMIEERLKTYAHLEDDKVMKQLKRRRYTGWGRLSRKLINGIRDKQSGKTILDF

LKSDGFANRNFMQLIHDDSLTFKEDIQKAQVSGQGDSLHEHIANLAGSPAIKKGILQT

VKVVDELVKVMGRHKPENIVIEMARENQTTQKGQKNSRERMKRIEEGIKELGSQILK

EHPVENTQLQNEKLYLYYLQNGRDMYVDQELDINRLSDYDVDHIVPQSFLKDDSID

-continued

NKVLTRSDKNRGKSDNVPSEEVVKKMKNYWRQLLNAKLITQRKFDNLTKAERGGL

SELDKAGFIKRQLVETRQITKHVAQILDSRMNTKYDENDKLIREVKVITLKSKLVSDF

RKDFQFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEIVWDKGRDF

ATVRKVLSMPQVNIVKKTEVQTGGFSKESILPKRNSDKLIARKKDWDPKKYGGFDSP

TVAYSVLVVAKVEKGKSKKLKSVKELLGITIMERSSFEKNPIDFLEAKGYKEVKKDLI

IKLPKYSLFELENGRKRMLASAGELQKGNELALPSKYVNFLYLASHYEKLKGSPEDN

EQKQLFVEQHKHYLDEIIEQISEFSKRVILADANLDKVLSAYNKHRDKPIREQAENIIH

LFTLTNLGAPAAFKYFDTTIDRKRYTSTKEVLDATLIHQSITGLYETRIDLSQLGGDSG

GS*PKKKRKV*

In some embodiments, the fusion protein comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 11-28, 387, 388, 440, 691-706, or to any of the fusion proteins provided herein. In some embodiments, the fusion protein comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 11-28, 387, 388, 440, 691-706, or any of the fusion proteins provided herein. In some embodiments, the fusion protein comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, at least 170, at least 200, at least 300, at least 400, at least 500, at least 600, at least 700, at least 800, at least 900, at least 1000, at least 1100, at least 1200, at least 1300, at least 1400, at least 1500, at least 1600, at least 1700, at least 1750, or at least 1800 identical contiguous amino acid residues as compared to any one of the amino acid sequences set forth in SEQ ID NOs: 11-28, 387, 388, 440, 691-706, or any of the fusion proteins provided herein.

Nucleic Acid Programmable DNA Binding Protein (napDNAbp) Complexes with Guide Nucleic Acids Some aspects of this disclosure provide complexes comprising any of the fusion proteins provided herein, and a guide nucleic acid bound to napDNAbp of the fusion protein. Some aspects of this disclosure provide complexes comprising any of the fusion proteins provided herein, and a guide RNA bound to a Cas9 domain (e.g., a dCas9, a nuclease active Cas9, or a Cas9 nickase) of fusion protein.

In some embodiments, the guide nucleic acid (e.g., guide RNA) is from 15-100 nucleotides long and comprises a sequence of at least 10 contiguous nucleotides that is complementary to a target sequence. In some embodiments, the guide RNA is 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides long. In some embodiments, the guide RNA comprises a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target sequence. In some embodiments, the target sequence is a DNA sequence. In some embodiments, the target sequence is an RNA sequence. In some embodiments, the target sequence is a sequence in the genome of a mammal. In some embodiments, the target sequence is a sequence in the genome of a human. In some embodiments, the 3' end of the target sequence is immediately adjacent to a canonical PAM sequence (NGG). In some embodiments, the guide nucleic acid (e.g., guide RNA) is complementary to a sequence associated with a disease or disorder. In some embodiments, the guide nucleic acid (e.g., guide RNA) is complementary to a sequence associated with a disease or disorder having a mutation in a gene selected from the genes disclosed in any one of Tables 1 and 2.

Methods of Using Fusion Proteins Comprising an Adenosine Deaminase and a Nucleic Acid Programmable DNA Binding Protein (napDNAbp) Domain Some aspects of this disclosure provide methods of using the fusion proteins, or complexes comprising a guide nucleic acid (e.g., gRNA) and a nucleobase editor provided herein. For example, some aspects of this disclosure provide methods comprising contacting a DNA, or RNA molecule with any of the fusion proteins provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising an adenosine deaminase and a Cas9 domain), or the complex, results in a correction of the point mutation. In some embodiments, the target DNA sequence comprises a G→A point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the contacting is in vivo in a subject. In some embodiments, the subject has or has been diagnosed with a disease or disorder. In some embodiments, the disease or disorder is phenylketonuria, von Willebrand disease (vWD), a neoplastic disease associated with a mutant PTEN or BRCA1, or Li-Fraumeni syndrome. A list of exemplary diseases and disorders that may be treated using the nucleobase editors provided herein is shown in Table 1. Table 1 includes the target gene, the mutation to be corrected, the related disease and the nucleotide sequence of the associated protospacer and PAM.

associated mutation in human cell culture. It will be understood by the skilled artisan that the nucleobase editing proteins provided herein, e.g., the fusion proteins comprising a nucleic acid programmable DNA binding protein (e.g., Cas9) and an adenosine deaminase domain can be used to correct any single point G to A or C to T mutation. In the first case, deamination of the mutant A to I corrects the mutation, and in the latter case, deamination of the A that is base-paired with the mutant T, followed by a round of replication, corrects the mutation. Exemplary point mutations that can be corrected are listed in Tables 1 and 2.

The successful correction of point mutations in disease-associated genes and alleles opens up new strategies for

TABLE 1

List of exemplary diseases that may be treated using the nucleobase editors provided herein. The A to be edited in the protospacer is indicated by underlining and the PAM is indicated in bold.

| Target Gene | Mutation | ATCC Cell Line | Disease | Protospacer and PAM |
|---|---|---|---|---|
| PTEN | Cys136Tyr | HTB-128 | Cancer Predisposition | TATATGCATATTTATTACATCGG (SEQ ID NO: 85) |
| PTEN | Arg233Ter | HTB-13 | Cancer Predisposition | CCGTCATGTGGGTCCTGAATTGG (SEQ ID NO: 86) |
| TP53 | Glu258Lys | HTB-65 | Cancer Predisposition | ACACTGAAAGACTCCAGGTCAGG (SEQ ID NO: 87) |
| BRCA1 | Gly1738Arg | NA | Cancer Predisposition | GTCAGAAGAGATGTGGTCAATGG (SEQ ID NO: 88) |
| BRCA1 | 4097-1G>A | NA | Cancer Predisposition | TTTAAAGTGAAGCAGCATCTGGG (SEQ ID NO: 89); ATTTAAAGTGAAGCAGCATCTGG (SEQ ID NO: 90) |
| PAH | Thr380Met | NA | Phenylketonuria | ACTCCATGACAGTGTAATTTGG (SEQ ID NO: 91) |
| VWF | Ser1285Phe | NA | von Willebrand (Hemophilia) | GCCTGGAGAAGCCATCCAGCAGG (SEQ ID NO: 92) |
| VWF | Arg2535Ter | NA | von Willebrand (Hemophilia) | CTCAGACACACTCATTGATGAGG (SEQ ID NO: 93) |
| TP53 | Arg175His | HCC1395 | Li-Fraumeni syndrome | GAGGCACTGCCCCCACCATGAGCG (SEQ ID NO: 94) |

Some embodiments provide methods for using the DNA editing fusion proteins provided herein. In some embodiments, the fusion protein is used to introduce a point mutation into a nucleic acid by deaminating a target nucleobase, e.g., an A residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein and an adenosine deaminase domain also have applications in "reverse" gene therapy, where certain gene functions are purposely suppressed or abolished. In these cases, site-specifically mutating residues that lead to inactivating mutations in a protein, or mutations that inhibit function of the protein can be used to abolish or inhibit protein function in vitro, ex vivo, or in vivo.

The instant disclosure provides methods for the treatment of a subject diagnosed with a disease associated with or caused by a point mutation that can be corrected by a DNA editing fusion protein provided herein. For example, in some embodiments, a method is provided that comprises administering to a subject having such a disease, e.g., a cancer associated with a point mutation as described above, an effective amount of an adenosine deaminase fusion protein that corrects the point mutation or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that can be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that can be corrected by deaminase-mediated gene editing. Some such diseases are described herein, and additional suitable diseases that can be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation: 2-methyl-3-hydroxybutyric aciduria; 3 beta-Hydroxysteroid dehydrogenase deficiency; 3-Methylglutaconic aciduria; 3-Oxo-5 alpha-steroid delta 4-dehydrogenase deficiency; 46,XY sex reversal, type 1, 3, and 5; 5-Oxoprolinase deficiency; 6-pyruvoyl-tetrahydropterin synthase deficiency; Aarskog syndrome; Aase syndrome; Achondrogenesis type 2; Achromatopsia 2 and 7; Acquired long QT syndrome; Acrocallosal syndrome, Schinzel type; Acrocapitofemoral dysplasia; Acrodysostosis 2, with or without hormone resistance; Acroerythrokeratoderma; Acromicric dysplasia; Acth-independent macronodular adrenal hyperplasia 2; Activated PI3K-delta syndrome; Acute intermittent porphyria; deficiency of Acyl-CoA dehydrogenase family, member 9; Adams-Oliver syndrome 5 and 6; Adenine phosphoribosyltransferase deficiency; Adenylate kinase deficiency; hemolytic anemia due to Adenylosuccinate lyase deficiency; Adolescent nephronophthisis; Renal-hepatic-pancreatic dysplasia; Meckel syndrome type 7; Adrenoleukodystrophy; Adult junctional epidermolysis bullosa; Epidermolysis bullosa, junctional, localisata variant; Adult neuronal ceroid lipofuscinosis; Adult neuronal ceroid lipofuscinosis; Adult onset ataxia with oculomotor apraxia; ADULT syndrome; Afibrinogenemia and congenital Afibrinogenemia; autosomal recessive Agammaglobulinemia 2; Age-related macular degeneration 3, 6, 11, and 12; Aicardi Goutieres syndromes 1, 4, and 5; Chilbain lupus 1; Alagille syndromes 1 and 2; Alexander disease; Alkaptonuria; Allan-Herndon-Dudley syndrome; Alopecia universalis congenital; Alpers encephalopathy; Alpha-1-antitrypsin deficiency; autosomal dominant, autosomal recessive, and X-linked recessive Alport syndromes; Alzheimer disease, familial, 3, with spastic paraparesis and apraxia; Alzheimer disease, types, 1, 3, and 4; hypocalcification type and hypomaturation type, HA1 Amelogenesis imperfecta; Aminoacylase 1 deficiency; Amish infantile epilepsy syndrome; Amyloidogenic transthyretin amyloidosis; Amyloid Cardiomyopathy, Transthyretin-related; Cardiomyopathy; Amyotrophic lateral sclerosis types 1, 6, 15 (with or without frontotemporal dementia), 22 (with or without frontotemporal dementia), and 10; Frontotemporal dementia with TDP43 inclusions, TARDBP-related; Andermann syndrome; Andersen Tawil syndrome; Congenital long QT syndrome; Anemia, nonspherocytic hemolytic, due to G6PD deficiency; Angelman syndrome; Severe neonatal-onset encephalopathy with microcephaly; susceptibility to Autism, X-linked 3; Angiopathy, hereditary, with nephropathy, aneurysms, and muscle cramps; Angiotensin i-converting enzyme, benign serum increase; Aniridia, cerebellar ataxia, and mental retardation; Anonychia; Antithrombin III deficiency; Antley-Bixler syndrome with genital anomalies and disordered steroidogenesis; Aortic aneurysm, familial thoracic 4, 6, and 9; Thoracic aortic aneurysms and aortic dissections; Multisystemic smooth muscle dysfunction syndrome; Moyamoya disease 5; Aplastic anemia; Apparent mineralocorticoid excess; Arginase deficiency; Argininosuccinate lyase deficiency; Aromatase deficiency; Arrhythmogenic right ventricular cardiomyopathy types 5, 8, and 10; Primary familial hypertrophic cardiomyopathy; Arthrogryposis multiplex congenita, distal, X-linked; Arthrogryposis renal dysfunction cholestasis syndrome; Arthrogryposis, renal dysfunction, and cholestasis 2; Asparagine synthetase deficiency; Abnormality of neuronal migration; Ataxia with vitamin E deficiency; Ataxia, sensory, autosomal dominant; Ataxia-telangiectasia syndrome; Hereditary cancer-predisposing syndrome; Atransferrinemia; Atrial fibrillation, familial, 11, 12, 13, and 16; Atrial septal defects 2, 4, and 7 (with or without atrioventricular conduction defects); Atrial standstill 2; Atrioventricular septal defect 4; Atrophia bulborum hereditaria; ATR-X syndrome; Auriculocondylar syndrome 2; Autoimmune disease, multisystem, infantile-onset; Autoimmune lymphoproliferative syndrome, type 1a; Autosomal dominant hypohidrotic ectodermal dysplasia; Autosomal dominant progressive external ophthalmoplegia with mitochondrial DNA deletions 1 and 3; Autosomal dominant torsion dystonia 4; Autosomal recessive centronuclear myopathy; Autosomal recessive congenital ichthyosis 1, 2, 3, 4A, and 4B; Autosomal recessive cutis laxa type IA and 1B; Autosomal recessive hypohidrotic ectodermal dysplasia syndrome; Ectodermal dysplasia 11b; hypohidrotic/hair/tooth type, autosomal recessive; Autosomal recessive hypophosphatemic bone disease; Axenfeld-Rieger syndrome type 3; Bainbridge-Ropers syndrome; Bannayan-Riley-Ruvalcaba syndrome; PTEN hamartoma tumor syndrome; Baraitser-Winter syndromes 1 and 2; Barakat syndrome; Bardet-Biedl syndromes 1, 11, 16, and 19; Bare lymphocyte syndrome type 2, complementation group E; Bartter syndrome antenatal type 2; Bartter syndrome types 3, 3 with hypocalciuria, and 4; Basal ganglia calcification, idiopathic, 4; Beaded hair; Benign familial hematuria; Benign familial neonatal seizures 1 and 2; Seizures, benign familial neonatal, 1, and/or myokymia; Seizures, Early infantile epileptic encephalopathy 7; Benign familial neonatal-infantile seizures; Benign hereditary chorea; Benign scapuloperoneal muscular dystrophy with cardiomyopathy; Bernard-Soulier syndrome, types A1 and A2 (autosomal dominant); Bestrophinopathy, autosomal recessive; beta Thalassemia; Bethlem myopathy and Bethlem myopathy 2; Bietti crystalline corneoretinal dystrophy; Bile acid synthesis defect, congenital, 2; Biotinidase deficiency; Birk Barel mental retardation dysmorphism syndrome; Blepharophimosis, ptosis, and epicanthus inversus; Bloom syndrome; Borjeson-Forssman-Lehmann syndrome; Boucher Neuhauser syndrome; Brachydactyly types A1 and A2; Brachydactyly with hypertension; Brain small vessel disease with hemorrhage; Branched-chain ketoacid dehydrogenase kinase deficiency; Branchiootic syndromes 2 and 3; Breast cancer, early-onset; Breast-ovarian cancer, familial 1, 2, and 4; Brittle cornea syndrome 2; Brody myopathy; Bronchiectasis with or without elevated sweat chloride 3; Brown-Vialetto-Van laere syndrome and Brown-Vialetto-Van Laere syndrome 2; Brugada syndrome; Brugada syndrome 1; Ventricular fibrillation; Paroxysmal familial ventricular fibrillation; Brugada syndrome and Brugada syndrome 4; Long QT syndrome; Sudden cardiac death; Bull eye macular dystrophy; Stargardt disease 4; Cone-rod dystrophy 12; Bullous ichthyosiform erythroderma; Burn-Mckeown syndrome; Candidiasis, familial, 2, 5, 6, and 8; Carbohydrate-deficient glycoprotein syndrome type I and II; Carbonic anhydrase VA deficiency, hyperammonemia due to; Carcinoma of colon; Cardiac arrhythmia; Long QT syndrome, LQT1 subtype; Cardioencephalomyopathy, fatal infantile, due to cytochrome c oxidase deficiency; Cardiofaciocutaneous syndrome; Cardiomyopathy; Danon disease; Hypertrophic cardiomyopathy; Left ventricular noncompaction cardiomyopathy; Carnevale syndrome; Carney complex, type 1; Carnitine acylcarnitine translocase deficiency; Carnitine palmitoyltransferase I, II, II (late onset), and II (infantile) deficiency; Cataract 1, 4, autosomal dominant, autosomal dominant, multiple types, with microcornea, coppock-like, juvenile, with microcornea and glucosuria, and nuclear diffuse nonprogressive; Catecholaminergic polymorphic ventricular tachycardia; Caudal regression syndrome; Cd8 deficiency, familial; Central core disease; Centromeric instability of chromosomes 1,9 and 16 and immunodeficiency; Cerebellar ataxia infantile with progressive external ophthalmoplegi and Cerebellar ataxia, mental retardation, and dysequilibrium syndrome 2; Cerebral amyloid angiopathy, APP-related; Cerebral autosomal dominant and recessive arteriopathy with subcortical infarcts and leukoencephalopathy; Cerebral cavernous malformations 2; Cerebrooculofacioskeletal syndrome 2; Cerebro-oculo-facioskeletal syndrome; Cerebroretinal microangiopathy with calcifications and cysts; Ceroid lipofuscinosis neuronal 2, 6, 7, and 10; Ch\xc3\xa9diak-Higashi syndrome, Chediak-Higashi syndrome, adult type; Charcot-Marie-Tooth disease types 1B, 2B2, 2C, 2F, 2I, 2U (axonal), 1C (demyelinating), dominant intermediate C, recessive intermediate A, 2A2, 4C, 4D, 4H, IF, IVF, and X; Scapuloperoneal spinal muscular atrophy; Distal spinal muscular atrophy, congenital nonprogressive; Spinal muscular atrophy, distal, autosomal recessive, 5; CHARGE association; Childhood hypophosphatasia; Adult hypophosphatasia; Cholecystitis; Progressive familial intrahepatic cholestasis 3; Cholestasis, intrahepatic, of pregnancy 3; Cholestanol storage disease; Cholesterol monooxygenase (side-chain cleaving) deficiency; Chondrodysplasia Blomstrand type; Chondrodysplasia punctata 1, X-linked recessive and 2 X-linked dominant; CHOPS syndrome; Chronic granulomatous disease, autosomal recessive cytochrome b-positive, types 1 and 2; Chudley-McCullough syndrome; Ciliary dyskinesia, primary, 7, 11, 15, 20 and 22; Citrullinemia type I; Citrullinemia type I and II; Cleidocranial dysostosis; C-like syndrome; Cockayne syndrome type A; Coenzyme Q10 deficiency, primary 1, 4, and 7; Coffin Siris/Intellectual Disability; Coffin-Lowry syndrome; Cohen syndrome; Cold-induced sweating syndrome 1; COLE-CARPENTER SYNDROME 2; Combined cellular and humoral immune defects with granulomas; Combined d-2- and 1-2-hydroxyglutaric aciduria; Combined malonic and methylmalonic aciduria; Combined oxidative phosphorylation deficiencies 1, 3, 4, 12, 15, and 25; Combined partial and complete 17-alpha-hydroxylase/17,20-lyase deficiency; Common variable immunodeficiency 9; Complement component 4, partial deficiency of, due to dysfunctional cl inhibitor; Complement factor B deficiency; Cone monochromatism; Cone-rod dystrophy 2 and 6; Cone-rod dystrophy amelogenesis imperfecta; Congenital adrenal hyperplasia and Congenital adrenal hypoplasia, X-linked; Congenital amegakaryocytic thrombocytopenia; Congenital aniridia; Congenital central hypoventilation; Hirschsprung disease 3; Congenital contractural arachnodactyly; Congenital contractures of the limbs and face, hypotonia, and developmental delay; Congenital disorder of glycosylation types 1B, 1D, 1G, 1H, 1J, 1K, 1N, 1P, 2C, 2J, 2K, IIm; Congenital dyserythropoietic anemia, type I and II; Congenital ectodermal dysplasia of face; Congenital erythropoietic porphyria; Congenital generalized lipodystrophy type 2; Congenital heart disease, multiple types, 2; Congenital heart disease; Interrupted aortic arch; Congenital lipomatous overgrowth, vascular malformations, and epidermal nevi; Non-small cell lung cancer; Neoplasm of ovary; Cardiac conduction defect, nonspecific; Congenital microvillous atrophy; Congenital muscular dystrophy; Congenital muscular dystrophy due to partial LAMA2 deficiency; Congenital muscular dystrophy-dystroglycanopathy with brain and eye anomalies, types A2, A7, A8, All, and A14; Congenital muscular dystrophy-dystroglycanopathy with mental retardation, types B2, B3, B5, and B15; Congenital muscular dystrophy-dystroglycanopathy without mental retardation, type B5; Congenital muscular hypertrophy-cerebral syndrome; Congenital myasthenic syndrome, acetazolamide-responsive; Congenital myopathy with fiber type disproportion; Congenital ocular coloboma; Congenital stationary night blindness, type 1A, 1B, 1C, 1E, 1F, and 2A; Coproporphyria; Cornea plana 2; Corneal dystrophy, Fuchs endothelial, 4; Corneal endothelial dystrophy type 2; Corneal fragility keratoglobus, blue sclerae and joint hypermobility; Cornelia de Lange syndromes 1 and 5; Coronary artery disease, autosomal dominant 2; Coronary heart disease; Hyperalphalipoproteinemia 2; Cortical dysplasia, complex, with other brain malformations 5 and 6; Cortical malformations, occipital; Corticosteroid-binding globulin deficiency; Corticosterone methyloxidase type 2 deficiency; Costello syndrome; Cowden syndrome 1; Coxa plana; Craniodiaphyseal dysplasia, autosomal dominant; Craniosynostosis 1 and 4; Craniosynostosis and dental anomalies; Creatine deficiency, X-linked; Crouzon syndrome; Cryptophthalmos syndrome; Cryptorchidism, unilateral or bilateral; Cushing symphalangism; Cutaneous malignant melanoma 1; Cutis laxa with osteodystrophy and with severe pulmonary, gastrointestinal, and urinary abnormalities; Cyanosis, transient neonatal and atypical nephropathic; Cystic fibrosis; Cystinuria; Cytochrome c oxidase i deficiency; Cytochrome-c oxidase deficiency; D-2-hydroxyglutaric aciduria 2; Darier disease, segmental; Deafness with labyrinthine aplasia microtia and microdontia (LAMM); Deafness, autosomal dominant 3a, 4, 12, 13, 15, autosomal dominant nonsyndromic sensorineural 17, 20, and 65; Deafness, autosomal recessive 1A, 2, 3, 6, 8, 9, 12, 15, 16, 18b, 22, 28, 31, 44, 49, 63, 77, 86, and 89; Deafness, cochlear, with myopia and intellectual impairment, without vestibular involvement, autosomal dominant, X-linked 2; Deficiency of 2-methylbutyryl-CoA dehydrogenase; Deficiency of 3-hydroxyacyl-CoA dehydrogenase; Deficiency of alpha-mannosidase; Deficiency of aromatic-L-amino-acid decarboxylase; Deficiency of bisphosphoglycerate mutase; Deficiency of butyryl-CoA dehydrogenase; Deficiency of ferroxidase; Deficiency of galactokinase; Deficiency of guanidinoacetate methyltransferase; Deficiency of hyaluronoglucosaminidase; Deficiency of ribose-5-phosphate isomerase; Deficiency of steroid 11-beta-monooxygenase; Deficiency of UDPglucose-hexose-1-phosphate uridylyltransferase; Deficiency of xanthine oxidase; Dejerine-Sottas disease; Charcot-Marie-Tooth disease, types ID and IVF; Dejerine-Sottas syndrome, autosomal dominant; Dendritic cell, monocyte, B lymphocyte, and natural killer lymphocyte deficiency; Desbuquois dysplasia 2; Desbuquois syndrome; DFNA 2 Nonsyndromic Hearing Loss; Diabetes mellitus and insipidus with optic atrophy and deafness; Diabetes mellitus, type 2, and insulindependent, 20; Diamond-Blackfan anemia 1, 5, 8, and 10; Diarrhea 3 (secretory sodium, congenital, syndromic) and 5 (with tufting enteropathy, congenital); Dicarboxylic aminoaciduria; Diffuse palmoplantar keratoderma, Bothnian type; Digitorenocerebral syndrome; Dihydropteridine reductase deficiency; Dilated cardiomyopathy 1A, 1AA, 1C, 1G, 1BB, 1DD, 1FF, 1HH, 1I, 1KK, 1N, 1S, 1Y, and 3B; Left ventricular noncompaction 3; Disordered steroidogenesis due to cytochrome p450 oxidoreductase deficiency; Distal arthrogryposis type 2B; Distal hereditary motor neuronopathy type 2B; Distal myopathy Markesbery-Griggs type; Distal spinal muscular atrophy, X-linked 3; Distichiasis-lymphedema syndrome; Dominant dystrophic epidermolysis bullosa with absence of skin; Dominant hereditary optic atrophy; Donnai Barrow syndrome; Dopamine beta hydroxylase deficiency; Dopamine receptor d2, reduced brain density of; Dowling-degos disease 4; Doyne honeycomb retinal dystrophy; Malattia leventinese; Duane syndrome type 2; Dubin-Johnson syndrome; Duchenne muscular dystrophy; Becker muscular dystrophy; Dysfibrinogenemia; Dyskeratosis congenita autosomal dominant and autosomal dominant, 3; Dyskeratosis congenita, autosomal recessive, 1, 3, 4, and 5; Dyskeratosis congenita X-linked; Dyskinesia, familial, with facial myokymia; Dysplasminogenemia; Dystonia 2 (torsion, autosomal recessive), 3 (torsion, X-linked), 5 (Dopa-responsive type), 10, 12, 16, 25, 26 (Myoclonic); Seizures, benign familial infantile, 2; Early infantile epileptic encephalopathy 2, 4, 7, 9, 10, 11, 13, and 14; Atypical Rett syndrome; Early T cell progenitor acute lymphoblastic leukemia; Ectodermal dysplasia skin fragility syndrome; Ectodermal dysplasia-syndactyly syndrome 1; Ectopia lentis, isolated autosomal recessive and dominant; Ectrodactyly, ectodermal dysplasia, and cleft lip/palate syndrome 3; Ehlers-Danlos syndrome type 7 (autosomal recessive), classic type, type 2 (progeroid), hydroxylysine-deficient, type 4, type 4 variant, and due to tenascin-X deficiency; Eichsfeld type congenital muscular dystrophy; Endocrine-cerebroosteodysplasia; Enhanced s-cone syndrome; Enlarged vestibular aqueduct syndrome; Enterokinase deficiency; Epidermodysplasia verruciformis; Epidermolysa bullosa simplex and limb girdle muscular dystrophy, simplex with mottled pigmentation, simplex with pyloric atresia, simplex, autosomal recessive, and with pyloric atresia; Epidermolytic palmoplantar keratoderma; Familial febrile seizures 8; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Epileptic encephalopathy, childhood-onset, early infantile, 1, 19, 23, 25, 30, and 32; Epiphyseal dysplasia, multiple, with myopia and conductive deafness; Episodic ataxia type 2; Episodic pain syndrome, familial, 3; Epstein syndrome; Fechtner syndrome; Erythropoietic protoporphyria; Estrogen resistance; Exudative vitreoretinopathy 6; Fabry disease and Fabry disease, cardiac variant; Factor H, VII, X, v and factor viii, combined deficiency of 2, xiii, a subunit, deficiency; Familial adenomatous polyposis 1 and 3; Familial amyloid nephropathy with urticaria and deafness; Familial cold urticarial; Familial aplasia of the vermis; Familial benign pemphigus; Familial cancer of breast; Breast cancer, susceptibility to; Osteosarcoma; Pancreatic cancer 3; Familial cardiomyopathy; Familial cold autoinflammatory syndrome 2; Familial colorectal cancer; Familial exudative vitreoretinopathy, X-linked; Familial hemiplegic migraine types 1 and 2; Familial hypercholesterolemia; Familial hypertrophic cardiomyopathy 1, 2, 3, 4, 7, 10, 23 and 24; Familial hypokalemia-hypomagnesemia; Familial hypoplastic, glomerulocystic kidney; Familial infantile myasthenia; Familial juvenile gout; Familial Mediterranean fever and Familial mediterranean fever, autosomal dominant; Familial porencephaly; Familial *porphyria* cutanea *tarda*; Familial pulmonary capillary hemangiomatosis; Familial renal glucosuria; Familial renal hypouricemia; Familial restrictive cardiomyopathy 1; Familial type 1 and 3 hyperlipoproteinemia; Fanconi anemia, complementation group E, I, N, and O; Fanconi-Bickel syndrome; Favism, susceptibility to; Febrile seizures, familial, 11; Feingold syndrome 1; Fetal hemoglobin quantitative trait locus 1; FG syndrome and FG syndrome 4; Fibrosis of extraocular muscles, congenital, 1, 2, 3a (with or without extraocular involvement), 3b; Fish-eye disease; Fleck corneal dystrophy; Floating-Harbor syndrome; Focal epilepsy with speech disorder with or without mental retardation; Focal segmental glomerulosclerosis 5; Forebrain defects; Frank Ter Haar syndrome; Borrone Di Rocco Crovato syndrome; Frasier syndrome; Wilms tumor 1; Freeman-Sheldon syndrome; Frontometaphyseal dysplasia land 3; Frontotemporal dementia; Frontotemporal dementia and/or amyotrophic lateral sclerosis 3 and 4; Frontotemporal Dementia Chromosome 3-Linked and Frontotemporal dementia ubiquitin-positive; Fructose-biphosphatase deficiency; Fuhrmann syndrome; Gamma-aminobutyric acid transaminase deficiency; Gamstorp-Wohlfart syndrome; Gaucher disease type 1 and Subacute neuronopathic; Gaze palsy, familial horizontal, with progressive scoliosis; Generalized dominant dystrophic epidermolysis bullosa; Generalized epilepsy with febrile seizures plus 3, type 1, type 2; Epileptic encephalopathy Lennox-Gastaut type; Giant axonal neuropathy; Glanzmann thrombasthenia; Glaucoma 1, open angle, e, F, and G; Glaucoma 3, primary congenital, d; Glaucoma, congenital and Glaucoma, congenital, Coloboma; Glaucoma, primary open angle, juvenile-onset; Glioma susceptibility 1; Glucose transporter type 1 deficiency syndrome; Glucose-6-phosphate transport defect; GLUT1 deficiency syndrome 2; Epilepsy, idiopathic generalized, susceptibility to, 12; Glutamate formiminotransferase deficiency; Glutaric acidemia IIA and IIB; Glutaric aciduria, type 1; Glutathione synthetase deficiency; Glycogen storage disease 0 (muscle), II (adult form), IXa2, IXc, type 1A; type II, type IV, IV (combined hepatic and myopathic), type V, and type VI; Goldmann-Favre syndrome; Gordon syndrome; Gorlin syndrome; Holoprosencephaly sequence; Holoprosencephaly 7; Granulomatous disease, chronic, X-linked, variant; Granulosa cell tumor of the ovary; Gray platelet syndrome; Griscelli syndrome type 3; Groenouw corneal dystrophy type I; Growth and mental retardation, mandibulofacial dysostosis, microcephaly, and cleft palate; Growth hormone deficiency with pituitary anomalies; Growth hormone insensitivity with immunodeficiency; GTP cyclohydrolase I deficiency; Hajdu-Cheney syndrome; Hand foot uterus syndrome; Hearing impairment; Hemangioma, capillary infantile; Hematologic neoplasm; Hemochromatosis type 1, 2B, and 3; Microvascular complications of diabetes 7; Transferrin serum level quantitative trait locus 2; Hemoglobin H disease, nondeletional; Hemolytic anemia, nonspherocytic, due to glucose phosphate isomerase deficiency; Hemophagocytic lymphohistiocytosis, familial, 2; Hemophagocytic lymphohistiocytosis, familial, 3; Heparin cofactor II deficiency; Hereditary acrodermatitis enteropathica; Hereditary breast and ovarian cancer syndrome;

Ataxia-telangiectasia-like disorder; Hereditary diffuse gastric cancer; Hereditary diffuse leukoencephalopathy with spheroids; Hereditary factors II, IX, VIII deficiency disease; Hereditary hemorrhagic telangiectasia type 2; Hereditary insensitivity to pain with anhidrosis; Hereditary lymphedema type I; Hereditary motor and sensory neuropathy with optic atrophy; Hereditary myopathy with early respiratory failure; Hereditary neuralgic amyotrophy; Hereditary Nonpolyposis Colorectal Neoplasms; Lynch syndrome I and II; Hereditary pancreatitis; Pancreatitis, chronic, susceptibility to; Hereditary sensory and autonomic neuropathy type IIB amd IIA; Hereditary sideroblastic anemia; Hermansky-Pudlak syndrome 1, 3, 4, and 6; Heterotaxy, visceral, 2, 4, and 6, autosomal; Heterotaxy, visceral, X-linked; Heterotopia; Histiocytic medullary reticulosis; Histiocytosis-lymphadenopathy plus syndrome; Holocarboxylase synthetase deficiency; Holoprosencephaly 2,3,7, and 9; Holt-Oram syndrome; Homocysteinemia due to MTHFR deficiency, CBS deficiency, and Homocystinuria, pyridoxine-responsive; Homocystinuria-Megaloblastic anemia due to defect in cobalamin metabolism, cblE complementation type; Howel-Evans syndrome; Hurler syndrome; Hutchinson-Gilford syndrome; Hydrocephalus; Hyperammonemia, type III; Hypercholesterolaemia and Hypercholesterolemia, autosomal recessive; Hyperekplexia 2 and Hyperekplexia hereditary; Hyperferritinemia cataract syndrome; Hyperglycinuria; Hyperimmunoglobulin D with periodic fever; Mevalonic aciduria; Hyperimmunoglobulin E syndrome; Hyperinsulinemic hypoglycemia familial 3, 4, and 5; Hyperinsulinism-hyperammonemia syndrome; Hyperlysinemia; Hypermanganesemia with dystonia, polycythemia and cirrhosis; Hyperornithinemia-hyperammonemia-homocitrullinuria syndrome; Hyperparathyroidism 1 and 2; Hyperparathyroidism, neonatal severe; Hyperphenylalaninemia, bh4-deficient, a, due to partial pts deficiency, BH4-deficient, D, and non-pku; Hyperphosphatasia with mental retardation syndrome 2, 3, and 4; Hypertrichotic osteochondrodysplasia; Hypobetalipoproteinemia, familial, associated with apob32; Hypocalcemia, autosomal dominant 1; Hypocalciuric hypercalcemia, familial, types 1 and 3; Hypochondrogenesis; Hypochromic microcytic anemia with iron overload; Hypoglycemia with deficiency of glycogen synthetase in the liver; Hypogonadotropic hypogonadism 11 with or without anosmia; Hypohidrotic ectodermal dysplasia with immune deficiency; Hypohidrotic X-linked ectodermal dysplasia; Hypokalemic periodic paralysis 1 and 2; Hypomagnesemia 1, intestinal; Hypomagnesemia, seizures, and mental retardation; Hypomyelinating leukodystrophy 7; Hypoplastic left heart syndrome; Atrioventricular septal defect and common atrioventricular junction; Hypospadias 1 and 2, X-linked; Hypothyroidism, congenital, nongoitrous, 1; Hypotrichosis 8 and 12; Hypotrichosis-lymphedema-telangiectasia syndrome; I blood group system; Ichthyosis bullosa of Siemens; Ichthyosis exfoliativa; Ichthyosis prematurity syndrome; Idiopathic basal ganglia calcification 5; Idiopathic fibrosing alveolitis, chronic form; Dyskeratosis congenita, autosomal dominant, 2 and 5; Idiopathic hypercalcemia of infancy; Immune dysfunction with T-cell inactivation due to calcium entry defect 2; Immunodeficiency 15, 16, 19, 30, 31C, 38, 40, 8, due to defect in cd3-zeta, with hyper IgM type 1 and 2, and X-Linked, with magnesium defect, Epstein-Barr virus infection, and neoplasia; Immunodeficiency-centromeric instability-facial anomalies syndrome 2; Inclusion body myopathy 2 and 3; Nonaka myopathy; Infantile convulsions and paroxysmal choreoathetosis, familial; Infantile cortical hyperostosis; Infantile GM1 gangliosidosis; Infantile hypophosphatasia; Infantile nephronophthisis; Infantile nystagmus, X-linked; Infantile Parkinsonism-dystonia; Infertility associated with multi-tailed spermatozoa and excessive DNA; Insulin resistance; Insulin-resistant diabetes mellitus and acanthosis *nigricans*; Insulin-dependent diabetes mellitus secretory diarrhea syndrome; Interstitial nephritis, karyomegalic; Intrauterine growth retardation, metaphyseal dysplasia, adrenal hypoplasia congenita, and genital anomalies; Iodotyrosyl coupling defect; IRAK4 deficiency; Iridogoniodysgenesis dominant type and type 1; Iron accumulation in brain; Ischiopatellar dysplasia; Islet cell hyperplasia; Isolated 17,20-lyase deficiency; Isolated lutropin deficiency; Isovaleryl-CoA dehydrogenase deficiency; Jankovic Rivera syndrome; Jervell and Lange-Nielsen syndrome 2; Joubert syndrome 1, 6, 7, 9/15 (digenic), 14, 16, and 17, and Orofaciodigital syndrome xiv; Junctional epidermolysis bullosa gravis of Herlitz; Juvenile GM>1<gangliosidosis; Juvenile polyposis syndrome; Juvenile polyposis/hereditary hemorrhagic telangiectasia syndrome; Juvenile retinoschisis; Kabuki make-up syndrome; Kallmann syndrome 1, 2, and 6; Delayed puberty; Kanzaki disease; Karak syndrome; Kartagener syndrome; Kenny-Caffey syndrome type 2; Keppen-Lubinsky syndrome; Keratoconus 1; Keratosis follicularis; Keratosis palmoplantaris *striata* 1; Kindler syndrome; L-2-hydroxyglutaric aciduria; Larsen syndrome, dominant type; Lattice corneal dystrophy Type III; Leber amaurosis; Zellweger syndrome; Peroxisome biogenesis disorders; Zellweger syndrome spectrum; Leber congenital amaurosis 11, 12, 13, 16, 4, 7, and 9; Leber optic atrophy; Aminoglycoside-induced deafness; Deafness, nonsyndromic sensorineural, mitochondrial; Left ventricular noncompaction 5; Left-right axis malformations; Leigh disease; Mitochondrial short-chain Enoyl-CoA Hydratase 1 deficiency; Leigh syndrome due to mitochondrial complex I deficiency; Leiner disease; Leri Weill dyschondrosteosis; Lethal congenital contracture syndrome 6; Leukocyte adhesion deficiency type I and III; Leukodystrophy, Hypomyelinating, 11 and 6; Leukoencephalopathy with ataxia, with Brainstem and Spinal Cord Involvement and Lactate Elevation, with vanishing white matter, and progressive, with ovarian failure; Leukonychia totalis; Lewy body dementia; Lichtenstein-Knorr Syndrome; Li-Fraumeni syndrome 1; Lig4 syndrome; Limb-girdle muscular dystrophy, type 1B, 2A, 2B, 2D, C1, C5, C9, C14; Congenital muscular dystrophy-dystroglycanopathy with brain and eye anomalies, type A14 and B14; Lipase deficiency combined; Lipid proteinosis; Lipodystrophy, familial partial, type 2 and 3; Lissencephaly 1, 2 (X-linked), 3, 6 (with microcephaly), X-linked; Subcortical laminar heterotopia, X-linked; Liver failure acute infantile; Loeys-Dietz syndrome 1, 2, 3; Long QT syndrome 1, 2, 2/9, 2/5, (digenic), 3, 5 and 5, acquired, susceptibility to; Lung cancer; Lymphedema, hereditary, id; Lymphedema, primary, with myelodysplasia; Lymphoproliferative syndrome 1, 1 (X-linked), and 2; Lysosomal acid lipase deficiency; Macrocephaly, macrosomia, facial dysmorphism syndrome; Macular dystrophy, vitelliform, adult-onset; Malignant hyperthermia susceptibility type 1; Malignant lymphoma, non-Hodgkin; Malignant melanoma; Malignant tumor of prostate; Mandibuloacral dysostosis; Mandibuloacral dysplasia with type A or B lipodystrophy, atypical; Mandibulofacial dysostosis, Treacher Collins type, autosomal recessive; Mannose-binding protein deficiency; Maple syrup urine disease type 1A and type 3; Marden Walker like syndrome; Marfan syndrome; Marinesco-Sj\xc3\xb6gren syndrome; Martsolf syndrome; Maturity-onset diabetes of the young, type 1, type 2, type 11, type 3, and type 9; May-Hegglin anomaly; MYH9 related disorders; Sebastian syndrome; McCune-Albright syndrome; Somatotroph adenoma; Sex cord-stromal tumor; Cushing syndrome; McKusick Kaufman syndrome; McLeod neuroacanthocytosis syndrome; Meckel-Gruber syndrome; Medium-chain acyl-coenzyme A dehydrogenase deficiency; Medulloblastoma; Megalencephalic leukoencephalopathy with subcortical cysts 1and 2a; Megalencephaly cutis marmorata telangiectatica congenital; PIK3CA Related Overgrowth Spectrum; Megalencephaly-polymicrogyria-polydactyly-hydrocephalus syndrome 2; Megaloblastic anemia, thiamine-responsive, with diabetes mellitus and sensorineural deafness; Meier-Gorlin syndromes 1and 4; Melnick-Needles syndrome; Meningioma; Mental retardation, X-linked, 3, 21, 30, and 72; Mental retardation and microcephaly with pontine and cerebellar hypoplasia; Mental retardation X-linked syndromic 5; Mental retardation, anterior maxillary protrusion, and strabismus; Mental retardation, autosomal dominant 12, 13, 15, 24, 3, 30, 4, 5, 6, and 9; Mental retardation, autosomal recessive 15, 44, 46, and 5; Mental retardation, stereotypic movements, epilepsy, and/or cerebral malformations; Mental retardation, syndromic, Claes-Jensen type, X-linked; Mental retardation, X-linked, nonspecific, syndromic, Hedera type, and syndromic, wu type; Merosin deficient congenital muscular dystrophy; Metachromatic leukodystrophy juvenile, late infantile, and adult types; Metachromatic leukodystrophy; Metatrophic dysplasia; Methemoglobinemia types I and 2; Methionine adenosyltransferase deficiency, autosomal dominant; Methylmalonic acidemia with homocystinuria; Methylmalonic aciduria cblB type; Methylmalonic aciduria due to methylmalonyl-CoA mutase deficiency; METHYLMALONIC ACIDURIA, mut(0) TYPE; Microcephalic osteodysplastic primordial dwarfism type 2; Microcephaly with or without chorioretinopathy, lymphedema, or mental retardation; Microcephaly, hiatal hernia and nephrotic syndrome; Microcephaly; Hypoplasia of the corpus callosum; Spastic paraplegia 50, autosomal recessive; Global developmental delay; CNS hypomyelination; Brain atrophy; Microcephaly, normal intelligence and immunodeficiency; Microcephaly-capillary malformation syndrome; Microcytic anemia; Microphthalmia syndromic 5, 7, and 9; Microphthalmia, isolated 3, 5, 6, 8, and with coloboma 6; Microspherophakia; Migraine, familial basilar; Miller syndrome; Minicore myopathy with external ophthalmoplegia; Myopathy, congenital with cores; Mitchell-Riley syndrome; mitochondrial 3-hydroxy-3-methylglutaryl-CoA synthase deficiency; Mitochondrial complex I, II, III, III (nuclear type 2, 4, or 8) deficiency; Mitochondrial DNA depletion syndrome 11, 12 (cardiomyopathic type), 2, 4B (MNGIE type), 8B (MNGIE type); Mitochondrial DNA-depletion syndrome 3 and 7, hepatocerebral types, and 13 (encephalomyopathic type); Mitochondrial phosphate carrier and pyruvate carrier deficiency; Mitochondrial trifunctional protein deficiency; Long-chain 3-hydroxyacyl-CoA dehydrogenase deficiency; Miyoshi muscular dystrophy 1; Myopathy, distal, with anterior tibial onset; Mohr-Tranebjaerg syndrome; Molybdenum cofactor deficiency, complementation group A; Mowat-Wilson syndrome; Mucolipidosis III Gamma; Mucopolysaccharidosis type VI, type VI (severe), and type VII; Mucopolysaccharidosis, MPS-I-H/S, MPS-II, MPS-III-A, MPS-III-B, MPS-III-C, MPS-IV-A, MPS-IV-B; Retinitis Pigmentosa 73; Gangliosidosis GM1 type1 (with cardiac involvement) 3; Multicentric osteolysis nephropathy; Multicentric osteolysis, nodulosis and arthropathy; Multiple congenital anomalies; Atrial septal defect 2; Multiple congenital anomalies-hypotonia-seizures syndrome 3; Multiple Cutaneous and Mucosal Venous Malformations; Multiple endocrine neoplasia, types 1and 4; Multiple epiphyseal dysplasia 5 or Dominant; Multiple gastrointestinal atresias; Multiple pterygium syndrome Escobar type; Multiple sulfatase deficiency; Multiple synostoses syndrome 3; Muscle AMP deaminase deficiency; Muscle eye brain disease; Muscular dystrophy, congenital, megaconial type; Myasthenia, familial infantile, 1; Myasthenic Syndrome, Congenital, 11, associated with acetylcholine receptor deficiency; Myasthenic Syndrome, Congenital, 17, 2A (slow-channel), 4B (fast-channel), and without tubular aggregates; Myeloperoxidase deficiency; MYH-associated polyposis; Endometrial carcinoma; Myocardial infarction 1; Myoclonic dystonia; Myoclonic-Atonic Epilepsy; Myoclonus with epilepsy with ragged red fibers; Myofibrillar myopathy 1 and ZASP-related; Myoglobinuria, acute recurrent, autosomal recessive; Myoneural gastrointestinal encephalopathy syndrome; Cerebellar ataxia infantile with progressive external ophthalmoplegia; Mitochondrial DNA depletion syndrome 4B, MNGIE type; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Myopia 6; Myosclerosis, autosomal recessive; Myotonia congenital; Congenital myotonia, autosomal dominant and recessive forms; Nail-patella syndrome; Nance-Horan syndrome; Nanophthalmos 2; Navajo neurohepatopathy; Nemaline myopathy 3 and 9; Neonatal hypotonia; Intellectual disability; Seizures; Delayed speech and language development; Mental retardation, autosomal dominant 31; Neonatal intrahepatic cholestasis caused by citrin deficiency; Nephrogenic diabetes insipidus, Nephrogenic diabetes insipidus, X-linked; Nephrolithiasis/osteoporosis, hypophosphatemic, 2; Nephronophthisis 13, 15 and 4; Infertility; Cerebello-oculo-renal syndrome (nephronophthisis, oculomotor apraxia and cerebellar abnormalities); Nephrotic syndrome, type 3, type 5, with or without ocular abnormalities, type 7, and type 9; Nestor-Guillermo progeria syndrome; Neu-Laxova syndrome 1; Neurodegeneration with brain iron accumulation 4 and 6; Neuroferritinopathy; Neurofibromatosis, type 1and type 2; Neurofibrosarcoma; Neurohypophyseal diabetes insipidus; Neuropathy, Hereditary Sensory, Type IC; Neutral 1 amino acid transport defect; Neutral lipid storage disease with myopathy; Neutrophil immunodeficiency syndrome; Nicolaides-Baraitser syndrome; Niemann-Pick disease type C1, C2, type A, and type C1, adult form; Non-ketotic hyperglycinemia; Noonan syndrome 1 and 4, LEOPARD syndrome 1; Noonan syndrome-like disorder with or without juvenile myelomonocytic leukemia; Normokalemic periodic paralysis, potassium-sensitive; Norum disease; Epilepsy, Hearing Loss, And Mental Retardation Syndrome; Mental Retardation, X-Linked 102 and syndromic 13; Obesity; Ocular albinism, type I; Oculocutaneous albinism type 1B, type 3, and type 4; Oculodentodigital dysplasia; Odontohypophosphatasia; Odontotrichomelic syndrome; Oguchi disease; Oligodontia-colorectal cancer syndrome; Opitz G/BBB syndrome; Optic atrophy 9; Oral-facial-digital syndrome; Ornithine aminotransferase deficiency; Orofacial cleft 11 and 7, Cleft lip/palate-ectodermal dysplasia syndrome; Orstavik Lindemann Solberg syndrome; Osteoarthritis with mild chondrodysplasia; Osteochondritis dissecans; Osteogenesis imperfecta type 12, type 5, type 7, type 8, type I, type III, with normal sclerae, dominant form, recessive perinatal lethal; *Osteopathia striata* with cranial sclerosis; Osteopetrosis autosomal dominant type 1 and 2, recessive 4, recessive 1, recessive 6; Osteoporosis with pseudoglioma; Oto-palato-digital syndrome, types I and II; Ovarian dysgenesis 1;

Ovarioleukodystrophy; Pachyonychia congenita 4 and type 2; Paget disease of bone, familial; Pallister-Hall syndrome; Palmoplantar keratoderma, nonepidermolytic, focal or diffuse; Pancreatic agenesis and congenital heart disease; Papillon-Lef\xc3\xa8vre syndrome; Paragangliomas 3; Paramyotonia congenita of von Eulenburg; Parathyroid carcinoma; Parkinson disease 14, 15, 19 (juvenile-onset), 2, 20 (early-onset), 6, (autosomal recessive early-onset, and 9; Partial albinism; Partial hypoxanthine-guanine phosphoribosyltransferase deficiency; Patterned dystrophy of retinal pigment epithelium; PC-K6a; Pelizaeus-Merzbacher disease; Pendred syndrome; Peripheral demyelinating neuropathy, central dysmyelination; Hirschsprung disease; Permanent neonatal diabetes mellitus; Diabetes mellitus, permanent neonatal, with neurologic features; Neonatal insulin-dependent diabetes mellitus; Maturity-onset diabetes of the young, type 2; Peroxisome biogenesis disorder 14B, 2A, 4A, 5B, 6A, 7A, and 7B; Perrault syndrome 4; Perry syndrome; Persistent hyperinsulinemic hypoglycemia of infancy; familial hyperinsulinism; Phenotypes; Phenylketonuria; Pheochromocytoma; Hereditary Paraganglioma-Pheochromocytoma Syndromes; Paragangliomas 1; Carcinoid tumor of intestine; Cowden syndrome 3; Phosphoglycerate dehydrogenase deficiency; Phosphoglycerate kinase 1 deficiency; Photosensitive trichothiodystrophy; Phytanic acid storage disease; Pick disease; Pierson syndrome; Pigmentary retinal dystrophy; Pigmented nodular adrenocortical disease, primary, 1; Pilomatrixoma; Pitt-Hopkins syndrome; Pituitary dependent hypercortisolism; Pituitary hormone deficiency, combined 1, 2, 3, and 4; Plasminogen activator inhibitor type 1 deficiency; Plasminogen deficiency, type I; Platelet-type bleeding disorder 15 and 8; Poikiloderma, hereditary fibrosing, with tendon contractures, myopathy, and pulmonary fibrosis; Polycystic kidney disease 2, adult type, and infantile type; Polycystic lipomembranous osteodysplasia with sclerosing leukoencephalopathy; Polyglucosan body myopathy 1 with or without immunodeficiency; Polymicrogyria, asymmetric, bilateral frontoparietal; Polyneuropathy, hearing loss, ataxia, retinitis pigmentosa, and cataract; Pontocerebellar hypoplasia type 4; Popliteal pterygium syndrome; Porencephaly 2; Porokeratosis 8, disseminated superficial actinic type; Porphobilinogen synthase deficiency; *Porphyria* cutanea *tarda*; Posterior column ataxia with retinitis pigmentosa; Posterior polar cataract type 2; Prader-Willi-like syndrome; Premature ovarian failure 4, 5, 7, and 9; Primary autosomal recessive microcephaly 10, 2, 3, and 5; Primary ciliary dyskinesia 24; Primary dilated cardiomyopathy; Left ventricular noncompaction 6; 4, Left ventricular noncompaction 10; Paroxysmal atrial fibrillation; Primary hyperoxaluria, type I, type, and type III; Primary hypertrophic osteoarthropathy, autosomal recessive 2; Primary hypomagnesemia; Primary open angle glaucoma juvenile onset 1; Primary pulmonary hypertension; Primrose syndrome; Progressive familial heart block type 1B; Progressive familial intrahepatic cholestasis 2 and 3; Progressive intrahepatic cholestasis; Progressive myoclonus epilepsy with ataxia; Progressive pseudorheumatoid dysplasia; Progressive sclerosing poliodystrophy; Prolidase deficiency; Proline dehydrogenase deficiency; Schizophrenia 4; Properdin deficiency, X-linked; Propionic academia; Proprotein convertase 1/3 deficiency; Prostate cancer, hereditary, 2; Protan defect; Proteinuria; Finnish congenital nephrotic syndrome; *Proteus* syndrome; Breast adenocarcinoma; Pseudoachondroplastic spondyloepiphyseal dysplasia syndrome; Pseudohypoaldosteronism type 1 autosomal dominant and recessive and type 2; Pseudohypoparathyroidism type 1A, Pseudopseudohypoparathyroidism; Pseudoneonatal adrenoleukodystrophy; Pseudoprimary hyperaldosteronism; Pseudoxanthoma elasticum; Generalized arterial calcification of infancy 2; Pseudoxanthoma elasticum-like disorder with multiple coagulation factor deficiency; Psoriasis susceptibility 2; PTEN hamartoma tumor syndrome; Pulmonary arterial hypertension related to hereditary hemorrhagic telangiectasia; Pulmonary Fibrosis And/Or Bone Marrow Failure, Telomere-Related, 1 and 3; Pulmonary hypertension, primary, 1, with hereditary hemorrhagic telangiectasia; Purine-nucleoside phosphorylase deficiency; Pyruvate carboxylase deficiency; Pyruvate dehydrogenase E1-alpha deficiency; Pyruvate kinase deficiency of red cells; Raine syndrome; Rasopathy; Recessive dystrophic epidermolysis bullosa; Nail disorder, nonsyndromic congenital, 8; Reifenstein syndrome; Renal adysplasia; Renal carnitine transport defect; Renal coloboma syndrome; Renal dysplasia; Renal dysplasia, retinal pigmentary dystrophy, cerebellar ataxia and skeletal dysplasia; Renal tubular acidosis, distal, autosomal recessive, with late-onset sensorineural hearing loss, or with hemolytic anemia; Renal tubular acidosis, proximal, with ocular abnormalities and mental retardation; Retinal cone dystrophy 3B; Retinitis pigmentosa; Retinitis pigmentosa 10, 11, 12, 14, 15, 17, and 19; Retinitis pigmentosa 2, 20, 25, 35, 36, 38, 39, 4, 40, 43, 45, 48, 66, 7, 70, 72; Retinoblastoma; Rett disorder; Rhabdoid tumor predisposition syndrome 2; Rhegmatogenous retinal detachment, autosomal dominant; Rhizomelic chondrodysplasia *punctata* type 2 and type 3; Roberts-SC phocomelia syndrome; Robinow Sorauf syndrome; Robinow syndrome, autosomal recessive, autosomal recessive, with brachy-syn-polydactyly; Rothmund-Thomson syndrome; Rapadilino syndrome; RRM2B-related mitochondrial disease; Rubinstein-Taybi syndrome; Salla disease; Sandhoff disease, adult and infantil types; Sarcoidosis, early-onset; Blau syndrome; Schindler disease, type 1; Schizencephaly; Schizophrenia 15; Schneckenbecken dysplasia; Schwannomatosis 2; Schwartz Jampel syndrome type 1; Sclerocornea, autosomal recessive; Sclerosteosis; Secondary hypothyroidism; Segawa syndrome, autosomal recessive; Senior-Loken syndrome 4 and 5; Sensory ataxic neuropathy, dysarthria, and ophthalmoparesis; Sepiapterin reductase deficiency; SeSAME syndrome; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Partial adenosine deaminase deficiency; Severe congenital neutropenia; Severe congenital neutropenia 3, autosomal recessive or dominant; Severe congenital neutropenia and 6, autosomal recessive; Severe myoclonic epilepsy in infancy; Generalized epilepsy with febrile seizures plus, types 1 and 2; Severe X-linked myotubular myopathy; Short QT syndrome 3; Short stature with nonspecific skeletal abnormalities; Short stature, auditory canal atresia, mandibular hypoplasia, skeletal abnormalities; Short stature, onychodysplasia, facial dysmorphism, and hypotrichosis; Primordial dwarfism; Short-rib thoracic dysplasia 11 or 3 with or without polydactyly; Sialidosis type I and II; Silver spastic paraplegia syndrome; Slowed nerve conduction velocity, autosomal dominant; Smith-Lemli-Opitz syndrome; Snyder Robinson syndrome; Somatotroph adenoma; Prolactinoma; familial, Pituitary adenoma predisposition; Sotos syndrome 1 or 2; Spastic ataxia 5, autosomal recessive, Charlevoix-Saguenay type, 1,10, or 11, autosomal recessive; Amyotrophic lateral sclerosis type 5; Spastic paraplegia 15, 2, 3, 35, 39, 4, autosomal dominant, 55, autosomal recessive, and 5A; Bile acid synthesis defect, congenital, 3; Spermatogenic failure 11, 3, and 8; Spherocytosis types 4 and 5; Spheroid body myopathy; Spinal muscular atrophy, lower extremity predominant 2, autosomal dominant; Spinal muscular atrophy, type II; Spinocerebellar ataxia 14, 21, 35, 40, and 6; Spinocerebellar ataxia autosomal recessive 1 and 16; Splenic hypoplasia; Spondylocarpotarsal synostosis syndrome; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Parastremmatic dwarfism; Stargardt disease 1; Cone-rod dystrophy 3; Stickler syndrome type 1; Kniest dysplasia; Stickler syndrome, types 1(nonsyndromic ocular) and 4; Sting-associated vasculopathy, infantile-onset; Stormorken syndrome; Sturge-Weber syndrome, Capillary malformations, congenital, 1; Succinyl-CoA acetoacetate transferase deficiency; Sucrase-isomaltase deficiency; Sudden infant death syndrome; Sulfite oxidase deficiency, isolated; Supravalvar aortic stenosis; Surfactant metabolism dysfunction, pulmonary, 2 and 3; Symphalangism, proximal, 1b; Syndactyly Cenani Lenz type; Syndactyly type 3; Syndromic X-linked mental retardation 16; Talipes equinovarus; Tangier disease; TARP syndrome; Tay-Sachs disease, B1 variant, Gm2-gangliosidosis (adult), Gm2-gangliosidosis (adult-onset); Temtamy syndrome; Tenorio Syndrome; Terminal osseous dysplasia; Testosterone 17-beta-dehydrogenase deficiency; Tetraamelia, autosomal recessive; Tetralogy of Fallot; Hypoplastic left heart syndrome 2; Truncus arteriosus; Malformation of the heart and great vessels; Ventricular septal defect 1; Thiel-Behnke corneal dystrophy; Thoracic aortic aneurysms and aortic dissections; Marfanoid habitus; Three M syndrome 2; Thrombocytopenia, platelet dysfunction, hemolysis, and imbalanced globin synthesis; Thrombocytopenia, X-linked; Thrombophilia, hereditary, due to protein C deficiency, autosomal dominant and recessive; Thyroid agenesis; Thyroid cancer, follicular; Thyroid hormone metabolism, abnormal; Thyroid hormone resistance, generalized, autosomal dominant; Thyrotoxic periodic paralysis and Thyrotoxic periodic paralysis 2; Thyrotropin-releasing hormone resistance, generalized; Timothy syndrome; TNF receptor-associated periodic fever syndrome (TRAPS); Tooth agenesis, selective, 3 and 4; Torsades de pointes; Townes-Brocks-branchiootorenal-like syndrome; Transient bullous dermolysis of the newborn; Treacher collins syndrome 1; Trichomegaly with mental retardation, dwarfism and pigmentary degeneration of retina; Trichorhinophalangeal dysplasia type I; Trichorhinophalangeal syndrome type 3; Trimethylaminuria; Tuberous sclerosis syndrome; Lymphangiomyomatosis; Tuberous sclerosis 1 and 2; Tyrosinase-negative oculocutaneous albinism; Tyrosinase-positive oculocutaneous albinism; Tyrosinemia type I; UDPglucose-4-epimerase deficiency; Ullrich congenital muscular dystrophy; Ulna and fibula absence of with severe limb deficiency; Upshaw-Schulman syndrome; Urocanate hydratase deficiency; Usher syndrome, types 1, 1B, 1D, 1G, 2A, 2C, and 2D; Retinitis pigmentosa 39; UV-sensitive syndrome; Van der Woude syndrome; Van Maldergem syndrome 2; Hennekam lymphangiectasia-lymphedema syndrome 2; Variegate *porphyria*; Ventriculomegaly with cystic kidney disease; Verheij syndrome; Very long chain acyl-CoA dehydrogenase deficiency; Vesicoureteral reflux 8; Visceral heterotaxy 5, autosomal; Visceral myopathy; Vitamin D-dependent rickets, types 1and 2; Vitelliform dystrophy; von Willebrand disease type 2M and type 3; Waardenburg syndrome type 1, 4C, and 2E (with neurologic involvement); Klein-Waardenberg syndrome; Walker-Warburg congenital muscular dystrophy; Warburg micro syndrome 2 and 4; Warts, hypogammaglobulinemia, infections, and myelokathexis; Weaver syndrome; Weill-Marchesani syndrome 1 and 3; Weill-Marchesani-like syndrome; Weissenbacher-Zweymuller syndrome; Werdnig-Hoffmann disease; Charcot-Marie-Tooth disease; Werner syndrome; WFS1-Related Disorders; Wiedemann-Steiner syndrome; Wilson disease; Wolfram-like syndrome, autosomal dominant; Worth disease; Van Buchem disease type 2; Xeroderma pigmentosum, complementation group b, group D, group E, and group G; X-linked agammaglobulinemia; X-linked hereditary motor and sensory neuropathy; X-linked ichthyosis with steryl-sulfatase deficiency; X-linked periventricular heterotopia; Oto-palato-digital syndrome, type I; X-linked severe combined immunodeficiency; Zimmermann-Laband syndrome and Zimmermann-Laband syndrome 2; and Zonular pulverulent cataract 3.

The instant disclosure provides lists of genes comprising pathogenic G to A or C to T mutations. Such pathogenic G to A or C to T mutations may be corrected using the methods and compositions provided herein, for example by mutating the A to a G, and/or the T to a C, thereby restoring gene function. Table 2 includes exemplary mutations that can be corrected using nucleobase editors provided herein. Table 2 includes the gene symbol, the associated phenotype, the mutation to be corrected and exemplary gRNA sequences which may be used to correct the mutations. The gRNA sequences provided in Table 2 are sequences that encode RNA that can direct Cas9, or any of the base editors provided herein, to a target site. For example, the gRNA sequences provided in Table 2 may be cloned into a gRNA expression vector, such as pFYF to encode a gRNA that targets Cas9, or any of the base editors provided herein, to a target site in order to correct a disease-related mutation. It should be appreciated, however, that additional mutations may be corrected to treat additional diseases associated with a G to A or C to T mutation. Furthermore, additional gRNAs may be designed based on the disclosure and the knowledge in the art, which would be appreciated by the skilled artisan.

TABLE 2

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338761 | SEPT9 | NM_006640.4(SEPT9):c.262C>T (p.Arg88Trp) | CCGAGCCGGTGTCCYGGCGCACT | Hereditary neuralgic amyotrophy |
| 80338762 | SEPT9 | NM_006640.4(SEPT9):c.278C>T (p.Ser93Phe) | CCCGGCGCACTGAGCTGTYCATT, CCGGGCGCACTGAGCTGTYCATTG | Hereditary neuralgic amyotrophy |
| 28934586 | CYP11B1 | NM_000497.3(CYP11B1):c.1343G>A (p.Arg448His) | GCATGCRCCAGTGCCTTGGGCGG | Deficiency of steroid 11-beta-monooxygenase |
| 748979061 | GRM6 | NM_000843.3(GRM6):c.1462C>T (p.Gln488Ter) | TGCCTRGTACCCGCCACTGCTGG | Congenital stationary night blindness, type 1B |
| 786205118 | CHKB | NM_005198.4(CHKB):c.677+1G>A | AACCTCAGRTGAGGGCAGGCAGG | Muscular dystrophy, congenital, megaconial type |
| 121965029 | IDUA | NM_000203.4(IDUA):c.266G>A (p.Arg89Gln) | GGTCCRGACCCACTGGCTGCTGG | Mucopolysaccharidosis, MPS-I-H/S, Hurler syndrome |
| 104893659 | PAX8 | NM_013953.3(PAX8):c.170G>A (p.Cys57Tyr) | GGCTRCGTCAGCAAGATCCTTGG | Thyroid agenesis |
| 104894062 | CYP11B1 | NM_000497.3(CYP11B1):c.1121G>A (p.Arg374Gln) | CTTGCRGTGGGTGCTGGCTGAGG | Deficiency of steroid 11-beta-monooxygenase |
| 104894231 | HRAS | NM_005343.2(HRAS):c.436G>A (p.Ala146Thr) | GACCTCGRCCAAGACCCGGCAGG | Costello syndrome |
| 104894335 | AQP2 | NM_000486.5(AQP2):c.523G>A (p.Gly175Arg) | CTTRGGGTAGGTCATGGCCATGG | |
| 104894341 | AQP2 | NM_000486.5(AQP2):c.568G>A (p.Ala190Thr) | CTGRCTCCAGCTGTCGTCACTGG | |
| 104894604 | NAGS | NM_153006.2(NAGS):c.971G>A (p.Trp324Ter) | AGTRGGTGAGCACAAAAGAACG | Hyperammonemia, type III |
| 104894832 | GLA | NM_000169.2(GLA):c.982G>A (p.Gly328Arg) | GCAARGGTACCAGCTTAGACAGG | Fabry disease |
| 104894842 | GLA | NM_000169.2(GLA):c.1020G>A (p.Trp340Ter) | GTGTGRGAACGACCTCTCCAGG | Fabry disease |
| 794726859 | SLC6A1 | NM_003042.3(SLC6A1):c.131G>A (p.Arg44Gln) | CCCGACCRGGACACGTGGAAGG, CCCCGACCRGGACACGTGGAAGG | MYOCLONIC-ATONIC EPILEPSY |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794727219 | HADHA | NM_000182.4(HADHA):c. 2146+1G>A | GGAGRTTGGTCTCGCAGGTTGGG, GGGAGRTTGGTCTCGCAGGTTGG | Mitochondrial trifunctional protein deficiency, Long-chain 3-hydroxyacyl-CoA dehydrogenase deficiency |
| 672601330 | ACY1 | NM_000666.2(ACY1):c.36 0-1G>A | TCARGTACCTGGAAGCTGTGAGG | Aminoacylase 1 deficiency |
| 794727995 | COPA | NM_001098398.1(COPA):c. 721G>A (p.Glu241Lys) | TGGRAGGTTGATACCTGCCGGGG, ATGGRAGGTTGATACCTGCCGGG, CATGGRAGGTTGATACCTGCCGG | |
| 794728029 | ACTA2 | NM_001613.2(ACTA2):c.8 09G>A (p.Gly270Glu) | TTTCCAGRGATGGAGTCTGCTGG | Thoracic aortic aneurysms and aortic dissections |
| 397514667 | CD27 | NM_001242.4(CD27):c.158 G>A (p.Cys53Tyr) | GGACTRTGACCAGATAGAAAGG | Lymphoproliferative syndrome 2 |
| 397514668 | GDF5 | NM_000557.4(GDF5):c.113 9G>A (p.Arg380Gln) | GCGAAAACRGCGGCCCCACTGG | Brachydactyly type A2 |
| 794729274 | TTN | NM_001256850.1(TTN):c.4 9637G>A (p.Trp16546Ter) | AGTGAGCTRGACTCCTCCTTTGG | not provided |
| 377461670 | MYH7 | NM_000257.3(MYH7):c.50 29C>T (p.Arg1677Cys) | GTTGTTGCRCCGCTCCACGATGG | Cardiomyopathy |
| 794729383 | TTN | NM_001256850.1(TTN):c.7 1708G>A (p.Trp23903Ter) | GTTAAATRGGGAAAGGTGGATGG | not provided |
| 121909129 | KRT86 | NM_002284.3(KRT86):c.12 37G>A (p.Glu413Lys) | GGAGGGCRAGGAGCAGAGGTGG G, TGGAGGGCRAGGAGCAGAGGTG G | Beaded hair, not provided |
| 397516208 | MYH7 | NM_000257.3(MYH7):c.42 76G>A (p.Glu1426Lys) | TGAGATCRAGGACTTGATGGCTGG | Cardiomyopathy, not specified |
| 397516211 | MYH7 | NM_000257.3(MYH7):c.43 48G>A (p.Asp1450Asn) | ACTTCRACAAGGTGGGCCCTGG, AACTTCRACAAGGTGGGCCCTGG | Cardiomyopathy, not specified |
| 386834035 | POMGNT1 | NM_017739.3(POMGNT1): c.652+1G>A | AAAGGAGRTGCCGGCATCAGAG G | Muscle eye brain disease, Congenital muscular dystrophy-dystroglycanopathy with mental retardation, type B3 |
| 752034900 | ACO2 | NM_001098.2(ACO2):c.19 81G>A (p.Gly661Arg) | GTGATCRGAGACGAGAACTACGG | Optic atrophy 9 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 57419521 | KRT81 | NM_002281.3(KRT81):c.1237G>A (p.Glu413Lys) | GGAGGGCRAGGAGCAGAGGTGG, TGGAGGGCRAGGAGCAGAGGTG G | Beaded hair, not provided |
| 774122562 | RDH5 | NM_002905.3(RDH5):c.285G>A (p.Trp95Ter) | GTGRGTGRGAGATGCACGTTAAGG | Pigmentary retinal dystrophy |
| 121908508 | SCO2 | NM_001169109.1(SCO2):c.107G>A (p.Trp36Ter) | TCCTRGCTTTTGTCAAGGCAGGG, GTCCTRGCTTTTGTCAAGGCAGG | Cardioencephalomyopathy, fatal infantile, due to cytochrome c oxidase deficiency |
| 199473684 | GLA | NM_000169.2(GLA):c.639+919G>A | CTARAGTGTAAGTTTCATGAGGG, ACTARAGTGTAAGTTTCATGAGG | Fabry disease, Fabry disease, cardiac variant |
| 121912591 | NAGS | NM_153006.2(NAGS):c.835G>A (p.Ala279Thr) | GGTGACCACCRCGTCGCTGGCCAAGG | Hyperammonemia, type III |
| 121912826 | COL4A3 | NM_000091.4(COL4A3):c.3044G>A (p.Gly1015Glu) | CCAGRAAGCATGGGAACATGG, ACCAGRAAGCATGGGAACATG G | Benign familial hematuria |
| 730880914 | MYH7 | NM_000257.3(MYH7):c.5030G>A (p.Arg1677His) | GCGGCRCAACAACCTGCTGCAGG | Cardiomyopathy |
| 121912932 | COL5A1 | NM_000093.4(COL5A1):c.4466G>A (p.Gly1489Glu) | ATCGRGCTCATCGTCCTCCGGG, GATCGRGCTCATCGTCCTCCGG | Ehlers-Danlos syndrome, classic type |
| 199474822 | | m.7444G>A | AAAATCTARACAAAAAAGGAAG | Leber optic atrophy, Aminoglycoside-induced deafness, Deafness, nonsyndromic sensorineural, mitochondrial |
| 398123050 | RTEL1 | NM_016434.3(RTEL1):c.2141+5G>A | GGTGCRTGCAGTCCCGTGGCAGG | Dyskeratosis congenita, autosomal recessive, 5 |
| 115556836 | PTCH1 | NM_000264.3(PTCH1):c.2183C>T (p.Thr728Met) | ACTTCRTACAGGGGGGCTCGAGG | Holoprosencephaly 7, not specified, not provided |
| 201540674 | RTEL1 | RTEL1:c.2402G>A (p.Arg801His) | TCCAGCRCTGCCAAGCCTGCTGG | Idiopathic fibrosing alveolitis, chronic form, Dyskeratosis congenita, autosomal recessive, 5, PULMONARY FIBROSIS AND/OR BONE MARROW FAILURE, TELOMERE-RELATED, 3 |
| 62638208 | GRM6 | NM_000843.3(GRM6):c.1565G>A (p.Cys522Tyr) | TGCCCTRCGGGCCGGGGAGCGG | Congenital stationary night blindness, type 1B, not provided |
| 62638625 | GRM6 | NM_000843.3(GRM6):c.2341G>A (p.Glu781Lys) | TTCAACRAGGCCAAGCCCATCGG | Congenital stationary night blindness, type 1B, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796053008 | SCN1A | NM_001165963.1(SCN1A): c.4285G>A (p.Ala1429Thr) | AATAGRCCACATTCAAAGGATGG | not provided |
| 121917756 | HRAS | NM_005343.2(HRAS):c.18 7G>A (p.Glu63Lys) | GGAGRAGTACAGCGCCATGCGG, AGGAGRAGTACAGCGCCATGCG G | Myopathy, congenital, with excess of muscle spindles |
| 121917775 | VIM | NM_003380.3(VIM):c.451 G>A (p.Glu151Lys) | CCCTCTACRAGGAGGAGATGCGGG, ACCTCTACRAGGAGGAGATGCGG | Cataract, nuclear diffuse nonprogressive, not provided |
| 121917995 | SCN1A | NM_006920.4(SCN1A):c.4 874G>A (p.Arg1625Gln) | TCCRAGTGATCCGTCTTGCTAGG | Generalized epilepsy with febrile seizures plus, type 2, Epileptic encephalopathy Lennox-Gastaut type, not provided |
| 121918805 | SCN1A | NM_006920.4(SCN1A):c.4 063G>A (p.Val1355Ile) | ATGGGCRTAAATTTGTTTGCTGG | Generalized epilepsy with febrile seizures plus, type 1, not provided |
| 768431507 | TTN | NM_001256850.1(TTN):c.4 9243C>T (p.Arg16415Ter) | CATTTCRGAACACTGAGCCAAGG | not provided |
| 368138001 | NPHP3 | NM_153240.4(NPHP3):c.3 373C>T (p.Arg1125Ter) | AACTCRCTCCCTCATTTCTAAGG | Adolescent nephronophthisis, Renal-hepatic-pancreatic dysplasia, not provided |
| 730880440 | GLA | NM_000169.2(GLA):c.101 9G>A (p.Trp340Ter) | GTGTRGGAACGACCTCTCTCAGG | not provided |
| 730880450 | GLA | NM_000169.2(GLA):c.713 G>A (p.Ser238Asn) | GAAAARTATAAAGAGTATCTTGG | not provided |
| 267606745 | COL4A3 | NM_000091.4(COL4A3):c. 3499G>A (p.Gly1167Arg) | GCCRGAGAAAGGGAGAAACGG, AGCCRGAGAAAGGGAGAAACG G | Alport syndrome, autosomal dominant |
| 267606961 | POMGNT1 | NM_001243766.1(POMGN T1):c.1425G>A (p.Trp475Ter) | GGGATTGRGACATGTGGATGCGG | not provided |
| 267607132 | TOP1 | NM_003286.2(TOP1):c.174 8G= (p.Gly583=) | CATGGAGGRCTTGACAGCCAAGG | not provided |
| 398122933 | CD27 | NM_001242.4(CD27):c.24 G>A (p.Trp8Ter) | CCTGTGTGRCTGTGCTTCTGGGG, CCCTGGTGRCTGTGCGTTCTGGG | Lymphoproliferative syndrome 2 |
| 398122944 | CRYGC | NM_020989.3(CRYGC):c.4 71G>A (p.Trp157Ter) | CTGRGGGGCCATGGATGCTAAGG | Cataract, coppock-like |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123019 | RTEL1 | NM_032957.4(RTEL1):c.82 3G>A (p.Glu275Lys) | CTTTGACRAAGCTCACAACCTGG | Dyskeratosis congenita, autosomal recessive, 5 |
| 281865424 | TYRP1 | NM_000550.2(TYRP1):c.1 067G>A (p.Arg356Gln) | AGTTTCCRAAACACAGTGGAAGG | Oculocutaneous albinism type 3 |
| 111033564 | PRSS1 | NM_002769.4(PRSS1):c.23 5G>A (p.Glu79Lys) | ACACATCRAAGTCCTGGAGGGG | Hereditary pancreatitis |
| 121434424 | GDF1 | NM_001492.5(GDF1):c.485 G>A (p.Gly162Asp) | GGGCGRCTGGGAGCTGAGCCTGG | Tetralogy of Fallot, not provided |
| 74315389 | GDF5 | NM_000557.4(GDF5):c.147 1G>A (p.Glu491Lys) | GCAGTATRAGGACATGGTCTGTGG | Symphalangism, proximal, 1b |
| 74315511 | SCO2 | NM_005138.2(SCO2):c.418 G>A (p.Glu140Lys) | CCCAGACRAGCTGGAGAAGCTGG | Myopia 6, Cardioencephalomyopathy, fatal infantile, due to cytochrome c oxidase deficiency, not provided |
| 137853207 | DDC | NM_001082971.1(DDC):c. 304G>A (p.Gly102Ser) | CATCRGCTTCTCCTGGGTGAGGG, GCATCRGCTTCTCCTGGGTGAGG | Deficiency of aromatic-L-amino-acid decarboxylase |
| 786201031 | SPECC1L | NM_015330.4(SPECC1L):c. 3247G>A (p.Gly1083Ser) | TGTCRGCATCAAATCCACACTGG | Opitz G/BBB syndrome |
| 387906858 | KCNJ13 | NM_002242.4(KCNJ13):c.4 96C>T (p.Arg166Ter) | AAAAGCTCRATTTTTTGGCCGGG | Leber congenital amaurosis 16 |
| 387907183 | ALG11 | NM_001004127.2(ALG11): c.1192G>A (p.Glu398Lys) | TGGAACRAGCATTTTGGGATTGG | Congenital disorder of glycosylation type 1P |
| 72646831 | TTN | NM_001267550.2(TTN):c.5 7331C>T (p.Arg19111Ter) | CCATGCTGAGGGGTGATCYGAA | Primary dilated cardiomyopathy, Dilated cardiomyopathy 1G, not provided |
| 750586158 | RAD50 | NM_005732.3(RAD50):c.3 598C>T (p.Arg1200Ter) | CCTTGGATATGCGAGGAYGATGC | Hereditary cancer-predisposing syndrome |
| 34516117 | KCNQ1 | NM_000218.1(KCNQ1):c.1 799C>T (p.Thr600Met) | CCTTTGTCCCCGCAGGTGAYGCA | Long QT syndrome, Congenital long QT syndrome, Cardiac arrhythmia |
| 786205700 | RTEL1 | NM_032957.4(RTEL1):c.15 23C>T (p.Pro508Leu) | CCACGGCACGCTGGCCCYGGTG | PULMONARY FIBROSIS AND/OR BONE MARROW FAILURE, TELOMERE-RELATED, 3 |
| 786205701 | RTEL1 | NM_032957.4(RTEL1):c.21 49C>T (p.Gln717Ter) | CCAGGGCTGTGAACYAGGCCATC | PULMONARY FIBROSIS AND/OR BONE MARROW FAILURE, TELOMERE-RELATED, 3 |
| 104893940 | ARG1 | NM_000045.3(ARG1):c.87 1C>T (p.Arg291Ter) | CCAGAAGAAGTAACTYGAACAGT | Arginase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894069 | CYP11B1 | NM_000497.3(CYP11B1):c.124C>T (p.Pro42Ser) | CCCTTTGAAGCCATGYCCCGGCG, CCTTTGAAGCCATGYCCCGGCGT | Congenital adrenal hyperplasia, Deficiency of steroid 11-beta-monooxygenase |
| 145100473 | SCO2 | NM_001169109.1(SCO2):c.341G>A (p.Arg114His) | CCGAAGTCAGCCTTGCAGYGAG | Myopia 6 |
| 104894333 | AQP2 | NM_000486.5(AQP2):c.374C>T (p.Thr125Met) | CCCCAGCTCAGCAACACAGCAYGAC, CCCAGCTCAGCAACACAGCAYGACG, CCAGCTCAGCAACACAGCAYGACGG | |
| 794726710 | SCN1A | NM_001165963.1(SCN1A):c.3637C>T (p.Arg1213Ter) | CCTGAGAAGGACGTGTTTCYGAA | Severe myoclonic epilepsy in infancy, not provided |
| 794726752 | SCN1A | NM_001165963.1(SCN1A):c.4573C>T (p.Arg1525Ter) | CCGCAAAAGCCTATACCTYGACC | Severe myoclonic epilepsy in infancy, not provided |
| 794726759 | SCN1A | NM_001165963.1(SCN1A):c.4933C>T (p.Arg1645Ter) | CCGTCTTGCTAGGATTGGCYGAA | Severe myoclonic epilepsy in infancy |
| 104894837 | GLA | NM_000169.2(GLA):c.436C>T (p.Pro146Ser) | CCTGCGCAGGCTTCYCTGGGAGT | Fabry disease |
| 200970763 | PIEZO1 | NM_001142864.3(PIEZO1):c.2344G>A (p.Gly782Ser) | CCGCTCAGCACCAGGCYCCACT | Xerocytosis |
| 794726988 | RAD51D | NM_002878.3(RAD51D):c.955C>T (p.Gln319Ter) | CCTGGGGACCTCAGAGYAGAGT | Breast-ovarian cancer, familial 4 |
| 794728015 | SOX18 | NM_018419.2(SOX18):c.481C>T (p.Gln161Ter) | CCGGCCGCGCCAAGAAGYAG, CCGGCCCGCAAGAAGYAGGCGC, CCGGCCCGCAAGAAGYAGGCGCG | Hypotrichosis-lymphedema-telangiectasia syndrome |
| 794728540 | KCNQ1 | NM_000218.2(KCNQ1):c.1801C>T (p.Gln601Ter) | CCCCGCAGGTGACYAGCTGGAC | Cardiac arrhythmia |
| 28940869 | POMGNT1 | NM_017739.3(POMGNT1):c.1324C>T (p.Arg442Cys) | CCCAGCACTACTGTACYGTGTGG, CCAGCACTACTGTACYGTGTGGA | Congenital muscular dystrophy |
| 794729279 | TTN | NM_001256850.1(TTN):c.58702C>T (p.Arg19568Ter) | CCCCTAAAGTCACTTGGYGAAAA, CCCTAAAGTCACTTGGYGAAAAG, CCTAAAGTCACTTGGYGAAAAGT | not provided |
| 794729305 | TTN | NM_001256850.1(TTN):c.96304C>T (p.Arg32102Ter) | CCGTGTAGGACAGGCCYGAGAA | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794729384 | TTN | NM_001256850.1(TTN):c.8 1193C>T (p.Arg27065Ter) | CCATTCAGAGCTTAYGAGGGACA | not provided |
| 397517326 | CDH23 | NM_022124.5(CDH23):c.3 628C>T (p.Gln1210Ter) | CCCCGTGTTCACAYAGCAGCAG | Usher syndrome, type 1D |
| 147708782 | MYH2 | NM_017534.5(MYH2):c.70 6G>A (p.Ala236Thr) | CCTCACGGTCTTGGYGTTGCCAA | Inclusion body myopathy 3 |
| 121908189 | MFRP | NM_031433.3(MFRP):c.52 3C>T (p.Gln175Ter) | CCACTGCGTGTGGCATATCYAGG | Nanophthalmos 2 |
| 121908350 | CDH23 | NM_022124.5(CDH23):c.3 880C>T (p.Gln1294Ter) | CCAGGCCCCCCCTTCAACYAGG, CCCCGCCCTTCAACYAGGGCTTC | Usher syndrome, type 1D |
| 121908490 | SGCE | NM_003919.2(SGCE):c.30 4C>T (p.Arg102Ter) | CCGACCTGGATGGCTTYGATATA | Myoclonic dystonia |
| 121909106 | FOXC2 | NM_005251.2(FOXC2):c.3 74C>T (p.Ser125Leu) | CCGCCACACCCTCYGCTCAACG | Distichiasis-lymphedema syndrome |
| 121909117 | SOX10 | NM_006941.3(SOX10):c.47 0C>T (p.Ala157Val) | CCCCTTCATCGAGGAGGYTGAGC, CCCTTCATCGAGGAGGYTGAGCG, CCTTCATCGAGGAGGYTGAGCGG | Waardenburg syndrome type 4C |
| 121909501 | TDGF1 | NM_001174136.1(TDGF1): c.326C>T (p.Pro109Leu) | CCCCATGACCACCTGGCTGCYCAA, CCATGACACCTGGCTGCYCAAG, CCATGACACCTGGCTGCYCAAGA | Forebrain defects |
| 121909511 | CHRNE | NM_000080.3(CHRNE):c.8 65C>T (p.Leu289Phe) | CCAGACCGTCTTCTTTGTTCYTCA, CCGTCTTCTTTGTTCYTCATTGCC | Myasthenia, familial infantile, 1 |
| 121909512 | CHRNE | NM_000080.3(CHRNE):c.4 22C>T (p.Pro141Leu) | CCGTGACGTGGCTGCCTCYGGCC | MYASTHENIC SYNDROME, CONGENITAL, 4B, FAST-CHANNEL |
| 121909595 | CRYGD | NM_006891.3(CRYGD):c.4 3C>T (p.Arg15Cys) | CCGGGGCTTCCAGGGCYGCCACT | Cataract 4 |
| 121912420 | SERPIND1 | NM_000185.3(SERPIND1): c.1385C>T (p.Pro462Leu) | CCACGGTGGGTTCATGCYGCTG | Heparin cofactor II deficiency |
| 111033571 | TRIM32 | NM_012210.3(TRIM32):c.3 88C>T (p.Pro130Ser) | CCGGGAGGCAGACCATCAGYCTC | Bardet-Biedl syndrome, Bardet-Biedl syndrome 11 |
| 121912700 | ACY1 | NM_000666.2(ACY1):c.58 9C>T (p.Arg197Trp) | CCTCCCCAGGGGTGYGGGTTACC | Aminoacylase 1 deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912978 | CYP11B2 | NM_000498.3(CYP11B2):c.554C>T (p.Thr185Ile) | CCCGGGGAGCCTGAYCCTGGAC, CCGGGGAGCCTGAYCCTGGACG | Corticosterone methyloxidase type 2 deficiency |
| 730882050 | ALG14 | NM_144988.3(ALG14):c.194C>T (p.Pro65Leu) | CCAATGCCTACTCACYTAGACAT | Myasthenic syndrome, congenital, without tubular aggregates |
| 761807131 | TTN | NM_001256850.1(TTN):c.46513+1G>A | CCATGTCCAAACTTAYGCTTTGG | not provided |
| 730882144 | MFRP | NM_031433.3(MFRP):c.1549C>T (p.Arg517Trp) | CCCTGCTACCAGCATTTCYGGAG, CCTGCTACCAGCATTTCYGGAGG | Microphthalmia, isolated 5 |
| 61752068 | RS1 | NM_000330.3(RS1):c.305G>A (p.Arg102Gln) | CCCTTGACTGTTGAGCYGGGCCTT | Juvenile retinoschisis, not provided |
| 119456962 | NPHP3 | NM_153240.4(NPHP3):c.1729C>T (p.Arg577Ter) | CCTCCTTGATTATTAAAYGACTA, CCTTGATTATTAAAYGACTAACT | Adolescent nephronophthisis, Renal-hepatic-pancreatic dysplasia, Meckel syndrome type 7, not provided |
| 74315310 | FCGR1A | NM_000566.3(FCGR1A):c.274C>T (p.Arg92Ter) | CCAGAGAGGTCTCTCAGGGYGAA | not provided |
| 41469351 | CCR5 | NM_000579.3(CCR5):c.229C>T | CCCGTAAATAAACCTTYAGACCA, CCGTAAATAAACCTTYAGACCAG | not provided |
| 62638185 | RDH5 | NM_002905.3(RDH5):c.218C>T (p.Ser73Phe) | CCTGCAGCGGGTGGCCTYCTCCC | not provided |
| 796053004 | SCN1A | NM_001165963.1(SCN1A):c.3985C>T (p.Arg1329Ter) | CCTCTAAGAGCCTTATCTYGATT | Severe myoclonic epilepsy in infancy, not provided |
| 796053103 | SCN1A | NM_001165963.1(SCN1A):c.5710C>T (p.Gln1904Ter) | CCTTCCAAGGTCTCCTATYAGCC, CCAAGGTCTCCTATYAGCCAATC | not provided |
| 121917886 | P2RY12 | NM_022788.4(P2RY12):c.793C>T (p.Arg265Trp) | CCCTGAGCCAAACCYGGGATGTC | Platelet-type bleeding disorder 8 |
| 121917903 | ERCC6 | NM_000124.3(ERCC6):c.229C>T (p.Arg77Ter) | CCCTGCTGCACATGCACYGACAT, CCTGCTGCACATGCACYGACATC | UV-sensitive syndrome |
| 121918450 | ITGB3 | NM_000212.2(ITGB3):c.2248C>T (p.Arg750Ter) | CCTCATCACCATCCACYGACGAA | Glanzmann thrombasthenia |
| 727503949 | GLA | NM_000169.2(GLA):c.658C>T (p.Arg220Ter) | CCCAATTATACAGAAATCYGACA, CCAATTATACAGAAATCYGACAG | Fabry disease |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 202102042 | NPPA | NM_006172.3(NPPA):c.449G>A (p.Arg150Gln) | CCCCAGTTCCTCTTACCYGGAAG, CCCAGTTCCTCTTACCYGGAAGC, CCAGTTCCTCTTACCYGGAAGCT | Atrial standstill 2 |
| 202003805 | PRSS1 | NM_002769.4(PRSS1):c.47C>T (p.Ala16Val) | CCACTCCAGTTGCTGYCCCCTTT | Hereditary pancreatitis |
| 587781698 | ATM | NM_000051.3(ATM):c.8998C>T (p.Gln3000Ter) | CCTTAGTGATATTGACYAGAGTT | Hereditary cancer-predisposing syndrome |
| 148231754 | TTN | NM_001256850.1(TTN):c.83086+5G>A | CCCTTCCCATGACAAATAYGTAC, CCTTCCCATGACAAATAYGTACC | not provided |
| 587781756 | RAD51D | NM_002878.3(RAD51D):c.451C>T (p.Gln151Ter) | CCGCTCCTCCAGCTGCTTYAGG, CCTCCTCCAGCTGCTTYAGCTA | Hereditary cancer-predisposing syndrome |
| 137853289 | ABCA12 | NM_173076.2(ABCA12):c.6610C>T (p.Arg2204Ter) | CCATGTTTTTTCCTTGYGACTC | Autosomal recessive congenital ichthyosis 4B |
| 116840809 | RPL35A | NM_000996.2(RPL35A):c.304C>T (p.Arg102Ter) | CCATTGGACACCAGAATCYGAGTG | Diamond-Blackfan anemia 5 |
| 587782695 | RAD51D | NM_002878.3(RAD51D):c.547C>T (p.Gln183Ter) | CCAGATGCTGGATGTGCTGYAGG | Hereditary cancer-predisposing syndrome |
| 119462978 | KIRREL3 | NM_032531.3(KIRREL3):c.118C>T (p.Arg40Trp) | CCAAGGACAAGTTTYGGAGAATG | Mental retardation, autosomal dominant 4 |
| 398123812 | SGCE | NM_003919.2(SGCE):c.709C>T (p.Arg237Ter) | CCCGTTTCTCTTCTTGTTTAYGAG, CCGTTTCTCTTCTTGTTTAYGAGA | not provided |
| 397518485 | TRAF3IP2 | NM_147686.3(TRAF3IP2):c.1580C>T (p.Thr527Ile) | CCCACCTGGCTTCAGAACAYTCA, CCACCTGGCTTCAGAACAYTCAT, CCTGGCTTCAGAACAYTCATGTC | Candidiasis, familial, 8 |
| 794726839 | SCN1A | NM_001165963.1(SCN1A):c.4985C>T (p.Ala1662Val) | CCGCACGCTGCTCTCTTTGYTTGA | Severe myoclonic epilepsy in infancy |
| 60035576 | KRT10 | NM_000421.3(KRT10):c.1300C>T (p.Gln434Ter) | CCAGAATACTGAATACCAAYAAC | Bullous ichthyosiform erythroderma, not provided |
| 779874042 | TTN | NM_001256850.1(TTN):c.77716G>T (p.Glu25906Ter) | CCCACACCAGCTGCATTTHAGC, CCACACCAGCTGCATTTHAGCA | not provided |
| 121434219 | ATM | NM_000051.3(ATM):c.9139C>T (p.Arg3047Ter) | CCCCAAAAATCTCAGCYGACTTT, CCAAAAATCTCAGCYGACTTTT, CCAAAAATCTCAGCYGACTTTC | Ataxia-telangiectasia syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434306 | LPAR6 | NM_005767.5(LPAR6):c.463C>T (p.Gln155Ter) | CCCGCCGTTTTGTTYAGTCTAC, CCGCCGTTTTTGTTYAGTCTACC | Hypotrichosis 8 |
| 121434405 | RPL5 | NM_000969.3(RPL5):c.67C>T (p.Arg23Ter) | CCAAGTGAAATTTAGAAGAYGAC | Aase syndrome |
| 121434410 | PRKRA | NM_003690.4(PRKRA):c.665C>T (p.Pro222Leu) | CCTTGAGGAATTCTCYTGGTGAA | Dystonia 16 |
| 121434534 | CYP19A1 | NM_031226.2(CYP19A1):c.1303C>T (p.Arg435Cys) | CCATTTGGCTTTGGGCCCYGTGG | Aromatase deficiency |
| 121434571 | ERCC5 | NM_000123.3(ERCC5):c.2375C>T (p.Ala792Val) | CCCATGGAAGCAGAGGYGCAGT G, CCATGGAAGCAGAGGYGCAGTG C | Xeroderma pigmentosum, group G |
| 137852293 | PHKA2 | NM_000292.2(PHKA2):c.3341C>T (p.Thr1114Ile) | CCCTTTGGTAGATGAYCCCGCAT, CCTTTGGTAGATGAYCCCGCATG | Glycogen storage disease IXa2 |
| 74315359 | PINK1 | NM_032409.2(PINK1):c.938C>T (p.Thr313Met) | CCTGGGCCATGGCCGGAYGCTGT | Parkinson disease 6, autosomal recessive early-onset |
| 372635387 | CHRNE | NM_000080.3(CHRNE):c.37G>A (p.Gly13Arg) | CCGTACCGAGAAGCCYCAAGAG | MYASTHENIC SYNDROME, CONGENITAL, 4B, FAST-CHANNEL |
| 74315520 | SOX10 | NM_006941.3(SOX10):c.1129C>T (p.Gln377Ter) | CCAGCCATCCACCTCAYAGATCG | Waardenburg syndrome type 4C, Waardenburg syndrome type 2E, with neurologic involvement |
| 74315521 | SOX10 | NM_006941.3(SOX10):c.748C>T (p.Gln250Ter) | CCCCAAGACAGAGCTGYAGTCG, CCCGAAGACAGAGCTGYAGTCG G, CCGAAGACAGAGCTGYAGTCGG | Peripheral demyelinating neuropathy, central dysmyelination, Waardenburg syndrome, and Hirschsprung disease |
| 137852824 | PCSK1 | NM_000439.4(PCSK1):c.920C>T (p.Ser307Leu) | CCATCTTCGTCTGGGCTTYGGGA | Proproteinconvertase 1/3 deficiency |
| 137852973 | BSCL2 | NM_001122955.3(BSCL2):c.461C>T (p.Ser154Leu) | CCCTGTTGCCAATGTCTYGCTGA, CCTGTTGCCAATGTCTYGCTGAC | Silver spastic paraplegia syndrome |
| 137852974 | BSCL2 | NM_001122955.3(BSCL2):c.1015C>T (p.Arg339Ter) | CCTCCACAGTTAACATCYGAAA, CCACAGTTAACATCYGAAAAAG | Congenital generalized lipodystrophy type 2 |
| 137853211 | DDC | NM_001082971.1(DDC):c.272C>T (p.Ala91Val) | CCCGGCCATGCTTGYGGACATGC | Deficiency of aromatic-L-amino-acid decarboxylase |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906570 | APOA1 | NM_000039.1(APOA1):c.7C>T (p.Gln23Ter) | CCAGGCTCGGCATTCTGGYAGC | Tangier disease |
| 387906669 | ACP5 | NM_001111035.1(ACP5):c.667C>T (p.Gln223Ter) | CCCACTGCCTGGTCAAGYAGCTA, CCACTGCCTGGTCAAGYAGCTAC | Spondyloenchondrodysplasia with immune dysregulation |
| 80051519 | CYP19A1 | NM_031226.2(CYP19A1):c.1094G>A (p.Arg365Gln) | CCACACAGGCTGTGTACYGCATG | Aromatase deficiency |
| 387907268 | PRCD | NM_001077620.2(PRCD):c.64C>T (p.Arg22Ter) | CCGGCCGATTTGCCAACYGAGTCC | Retinitis pigmentosa 36 |
| 387907279 | FAN1 | NM_014967.4(FAN1):c.2245C>T (p.Arg749Ter) | CCGGCCTTTCACTGTATCAGYGAG, CCTTTCACTGTATCAGYGAGCCG | Interstitial nephritis, karyomegalic |
| 543267101 | AARS2 | NM_020745.3(AARS2):c.2893G>A (p.Gly965Arg) | CCAGGTCAGTAGTGCTTCYGGTG | Leukoencephalopathy, progressive, with ovarian failure |
| 587777592 | AARS2 | NM_020745.3(AARS2):c.1213G>A (p.Glu405Lys) | CCAGGAAGGCTGCCTYGTCCTCT | Leukoencephalopathy, progressive, with ovarian failure |
| 587777125 | AASS | NM_005763.3(AASS):c.194G>A (p.Arg65Gln) | CCCTTATCATGAATGCCYGCCGA | Hyperlysinemia |
| 121434578 | ABAT | NM_000663.4(ABAT):c.659G>A (p.Arg220Lys) | GGGARGACCATGGGTAAGGAGG, TGGGARGACCATGGGTAAGGAG, CCATGGGARGACCATGGGTAAGG | Gamma-aminobutyric acid transaminase deficiency |
| 724159990 | ABAT | NM_000663.4(ABAT):c.631C>T (p.Leu211Phe) | CCCCGACTACAGCATCYTCTCCT, CCGACTACAGCATCYTCTCCTT, CCGACTACAGCATCYTCTCCTTC | Gamma-aminobutyric acid transaminase deficiency |
| 137854495 | ABCA1 | NM_005502.3(ABCA1):c.2810C>T (p.Ala937Val) | CCTGGGCCACAATGGAGYGGGG A | Tangier disease |
| 28940270 | ABCA12 | NM_173076.2(ABCA12):c.4541G>A (p.Arg1514His) | ATGTTCTCRCCGAAGTATATGGG | Autosomal recessive congenital ichthyosis 4A |
| 121909181 | ABCA3 | NM_001089.2(ABCA3):c.3426G>A (p.Trp1142Ter) | CTGRCTCTCTGCTCTGTGGG, TCTGRCTCTCTGCTCTGCTGTGG | Surfactant metabolism dysfunction, pulmonary, 3 |
| 61750061 | ABCA4 | NM_000350.2(ABCA4):c.3106G>A (p.Glu1036Lys) | GTCCCAGRAGGAGGCCCAGCTGG | Stargardt disease 1, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61751399 | ABCA4 | NM_000350.2(ABCA4):c. 364G>A (p.Glu122Lys) | GGACRAGGCCGACCTCCTTGGGG, TGGACRAGGCCGACCTCCTTGGG, ATGGACRAGGCCGACCTCCTTGG | Stargardt disease 1, not provided |
| 1800553 | ABCA4 | NM_000350.2(ABCA4):c. 882G>A (p.Gly1961Glu) | TGTCCRAGTTCGCCCTGGAGAGG | Stargardt disease 1, Cone-rod dystrophy 3, not provided |
| 794727531 | ABCA4 | NM_000350.2(ABCA4):c. 429C>T (p.Gln1477Ter) | CCCAGCTGTTCCAGAAGYAGAAA, CCAGCTGTTCCAGAAGYAGAAAT | Stargardt disease 1 |
| 794727903 | ABCA4 | NM_000350.2(ABCA4):c. 80C>T (p.Gln294Ter) | CCATCGGCCCAGTATGYAGGACT | Stargardt disease 1, Cone-rod dystrophy 3 |
| 61748550 | ABCA4 | NM_000350.2(ABCA4):c. 222C>T (p.Arg408Ter) | CCTGATTCACCTGAGCAYGAAG | Retinitis pigmentosa 19, Stargardt disease 1, Cone-rod dystrophy 3, Age-related macular degeneration 2, not provided |
| 61750130 | ABCA4 | NM_000350.2(ABCA4):c. 139C>T (p.Pro1380Leu) | CCCACAGATCGTGCTCCYGGCTA, CCACAGATCGTGCTCCYGGCTAC | Stargardt disease 1, not provided |
| 28938473 | ABCA4 | NM_000350.2(ABCA4):c. 908C>T (p.Leu1970Phe) | CCTAGTGCTTTGGCYTCCTGGGA | Stargardt disease, not provided |
| 72549401 | ABCB11 | NM_003742.2(ABCB11):c. 1723C>T (p.Arg575Ter) | GGGGATTTCRGATGAGGGCTCTGG | Progressive familial intrahepatic cholestasis 2 |
| 72552778 | ABCB4 | NM_018849.2(ABCB4):c. 59C>T (p.Ser320Phe) | CCTTCTGGTATGGATYCACTCTA | Cholecystitis, Progressive familial intrahepatic cholestasis 3, Cholestasis, intrahepatic, of pregnancy 3 |
| 121918440 | ABCB4 | NM_018849.2(ABCB4):c. 869C>T (p.Arg957Ter) | CCTATGCCCGTTGTTTTYGATTT | Progressive familial intrahepatic cholestasis 3, Cholestasis, intrahepatic, of pregnancy 3 |
| 121918442 | ABCB4 | NM_018849.2(ABCB4):c. 502C>T (p.Pro1168Ser) | CCTTTCATCGAGACGTTAYCCCA | Cholecystitis |
| 72558200 | ABCC2 | NM_000392.4(ABCC2):c. 449G>A (p.Arg1150His) | GGCRTCTGGACTCTGTCACCAGG | Dubin-Johnson syndrome |
| 63749823 | ABCC6 | NM_001171.5(ABCC6):c. 961G>A (p.Gly1321Ser) | GAGRGTGGGATCTGGATCGACGG | Pseudoxanthoma elasticum |
| 28939701 | ABCC6 | NM_001171.5(ABCC6):c. 412C>T (p.Arg1138Trp) | CCAGGGCAGCACAGTGGTCYGG | Pseudoxanthoma elasticum |
| 72653744 | ABCC6 | NM_001171.5(ABCC6):c. 490C>T (p.Arg164Ter) | CCAGAGGATCAGTTYCCCYGAC | Pseudoxanthoma elasticum |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 63750459 | ABCC6 | NM_001171.5(ABCC6):c.3 389C>T (p.Thr1130Met) | CCCACATGGCTGAGAYGTTCCAG, CCACATGGCTGAGAYGTTCCAGG | Pseudoxanthoma elasticum |
| 63750759 | ABCC6 | NM_001171.5(ABCC6):c.3 940C>T (p.Arg1314Trp) | CCTGCCCAGTGGGCTGCTGYGGC, CCAGTGGGCTGCTGYGGCCTCCAG | Pseudoxanthoma elasticum, Generalized arterial calcification of infancy 2 |
| 193922402 | ABCC8 | NM_000352.4(ABCC8):c.4 306C>T (p.Arg1436Ter) | CCTCTTCAGCGGCCACCATCYGGT | Persistent hyperinsulinemic hypoglycemia of infancy, familial hyperinsulinism |
| 387906805 | ABCC9 | NM_005691.3(ABCC9):c.4 640C>T (p.Thr1547Ile) | CCACTTTGGTGATGAYCAACAAG | Atrial fibrillation, familial, 12 |
| 387907228 | ABCC9 | NM_005691.3(ABCC9):c.3 346C>T (p.Arg1116Cys) | CCTTGGAATCTCTAACTYGCTCA | Hypertrichotic osteochondrodysplasia |
| 11146842 | ABCD1 | NM_000033.3(ABCD1):c.1 850G>A (p.Arg617His) | TGGCCRCCATGTTCTACCACAGG | Adrenoleukodystrophy |
| 150346282 | ABCD1 | NM_000033.3(ABCD1):c.1 825G>A (p.Glu609Lys) | GGTGCGCRAGAAGCAGAGAATCG G | Adrenoleukodystrophy |
| 128624213 | ABCD1 | NM_000033.3(ABCD1):c.8 71G>A (p.Glu291Lys) | TCGRAGGAGGATCGCCTTCTATGG | Adrenoleukodystrophy |
| 128624218 | ABCD1 | NM_000033.3(ABCD1):c.7 96G>A (p.Gly266Arg) | GTTCRGGGAGCTGGTGGCAGAGG | Adrenoleukodystrophy |
| 398123102 | ABCD1 | NM_000033.3(ABCD1):c.1 553G>A (p.Arg518Gln) | TCCRGATCCTGGGTGGGCTCTGG | Adrenoleukodystrophy |
| 398123107 | ABCD1 | NM_000033.3(ABCD1):c.1 802G>A (p.Trp601Ter) | GACTRGAAGGACGTCCTGTCGGG, TGACTRGAAGGACGTCCTGTCGG | Adrenoleukodystrophy |
| 398123105 | ABCD1 | NM_000033.3(ABCD1):c.1 679C>T (p.Pro560Leu) | CCAGGTGATCTACCYGGACTCAG | Adrenoleukodystrophy |
| 398123106 | ABCD1 | NM_000033.3(ABCD1):c.1 771C>T (p.Arg591Trp) | CCTGCACCACATCCTGCAGYGGG | Adrenoleukodystrophy |
| 587777603 | ABHD12 | NM_015600.4(ABHD12):c. 477G>A (p.Trp159Ter) | CCAAGGCATCCTCATAYCACATC | Polyneuropathy, hearing loss, ataxia, retinitis pigmentosa, and cataract |
| 387906517 | ABL1 | NM_007313.2(ABL1):c.763 G>A (p.Glu255Lys) | CAAGTGGRAGATGAACGCACG G | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913459 | ABL1 | NM_007313.2(ABL1):c.1001C>T (p.Thr334Ile) | CCCCGTTCTATATCATCAYTGA, CCCGTTCTATATCATCAYTGAG, CCGTTCTATATCATCAYTGAGT, CGTTCTATATCATCAYTGAGTT | |
| 368949613 | ACAD9 | NM_014049.4(ACAD9):c.1249C>T (p.Arg417Cys) | CCGTACGACGCCATACTGYGTGA | Acyl-CoA dehydrogenase family, member 9, deficiency of |
| 121434278 | ACADM | NM_000016.5(ACADM):c.583G>A (p.Gly195Arg) | CCAACRGAGGAAAAGCTAATTGG | Medium-chain acyl-coenzyme A dehydrogenase deficiency, not provided |
| 1799958 | ACADS | NM_000017.3(ACADS):c.625G>A (p.Gly209Ser) | TCAGRGGCATCAGTGCCTTCCTGG | Deficiency of butyryl-CoA dehydrogenase, not specified, not provided |
| 387906951 | ACADS | NM_000017.3(ACADS):c.323G>A (p.Gly108Asp) | AGCCCGTGRCCTGCGCCTCCACCGG | Deficiency of butyryl-CoA dehydrogenase |
| 28940872 | ACADS | NM_000017.3(ACADS):c.1147C>T (p.Arg383Cys) | CCGGCAGAGGCGGCACTACYGCGA | Deficiency of butyryl-CoA dehydrogenase, not provided |
| 28940874 | ACADS | NM_000017.3(ACADS):c.575C>T (p.Ala192Val) | CCAATGCCTGGGAGGYTTCCGCT | Deficiency of butyryl-CoA dehydrogenase |
| 28941773 | ACADS | NM_000017.3(ACADS):c.1058C>T (p.Ser353Leu) | CCAAGCTGGCCGCCTYGGAGGCC | Deficiency of butyryl-CoA dehydrogenase |
| 121908006 | ACADS | NM_000017.3(ACADS):c.973C>T (p.Arg325Trp) | CCTGCCCTGGAGAGTGCCYGGC, CCCTGGAGAGTGCCYGGCTGCTG | Deficiency of butyryl-CoA dehydrogenase, not provided |
| 61732144 | ACADS | NM_000017.3(ACADS):c.319C>T (p.Arg107Cys) | CCATCGAGGAGATCAGCYGTGGC | Deficiency of butyryl-CoA dehydrogenase, not provided |
| 147442301 | ACADS | NM_000017.3(ACADS):c.164C>T (p.Pro55Leu) | CCGAGAAGGAGTTGTTTCYCATT | Deficiency of butyryl-CoA dehydrogenase |
| 188094280 | ACADSB | NM_001609.3(ACADSB):c.1159G>A (p.Glu387Lys) | ATCRAGTGGATGGGGGAGTAG G | Deficiency of 2-methylbutyryl-CoA dehydrogenase |
| 137852649 | ACADSB | NM_001609.3(ACADSB):c.763C>T (p.Leu255Phe) | CCTGAAAACAAATTGGGGYTCAG | Deficiency of 2-methylbutyryl-CoA dehydrogenase |
| 533055438 | ACADVL | NM_000018.3(ACADVL):c.1316G>A (p.Gly439Asp) | GGGGGRTATGGGCTTCATGAAGG | not provided |
| 2309689 | ACADVL | NM_000018.3(ACADVL):c.1322G>A (p.Gly441Asp) | TATGGRCTTCATGAAGGRTACAGG | Very long chain acyl-CoA dehydrogenase deficiency, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 766742117 | ACADVL | NM_000018.3(ACADVL):c.1375C>T (p.Arg459Trp) | CCGAGATCTTCGCATCTTCYGGA | not provided |
| 118204014 | ACADVL | NM_000018.3(ACADVL):c.1837C>T (p.Arg613Trp) | CCCCAGGCTGCAGCTYGGATCCG, CCCAGGCTGCAGCTYGGATCCGA | Very long chain acyl-CoA dehydrogenase deficiency, not provided |
| 121913568 | ACAN | NM_013227.3(ACAN):c.7141G>A (p.Asp2381Asn) | GAACRACAGGACCATCGAAGGG, TGAACRACAGGACCATCGAAGG G, CTGAACRACAAGGACCATCGAAGG | Spondyloepimetaphyseal dysplasia, Aggrecan type |
| 267606625 | ACAN | NM_013227.3(ACAN):c.7249G>A (p.Val2417Met) | AGGACTGTRTGGTGATGATCTGG | Osteochondritis dissecans |
| 121912703 | ACE | NM_000789.3(ACE):c.3683C>T (p.Pro1228Leu) | CCGCAGTACAACTGGACGCYGAA | Angiotensin i-converting enzyme, benign serum increase |
| 118204093 | ACOX1 | NM_004035.6(ACOX1):c.442C>T (p.Arg148Ter) | CCTTAGGAACTCACCTTYGAGGC | Pseudoneonatal adrenoleukodystrophy |
| 757905943 | ACSF3 | NM_174917.4(ACSF3):c.348G>A (p.Trp116Ter) | GTCATGRATGAGTGGCGGTGTGG | not provided |
| 138680796 | ACSF3 | NM_174917.4(ACSF3):c.1411C>T (p.Arg471Trp) | CCAGTACTGATCCGAGGCYGGA | Combined malonic and methylmalonic aciduria |
| 140986055 | ACSF3 | NM_174917.4(ACSF3):c.728C>T (p.Pro243Leu) | CCTCCACGTGCTCCYGCTGCACC | Combined malonic and methylmalonic aciduria |
| 367543051 | ACTA1 | NM_001100.3(ACTA1):c.727G>A (p.Glu243Lys) | CTACRAGCTGCCAGACGGGCAGG, AGAGCTACRAGCTGCCAGACGGG | Congenital myopathy with fiber type disproportion |
| 267606627 | ACTA1 | NM_001100.3(ACTA1):c.223C>T (p.His75Tyr) | CCTGAAGTACCCTATCGAGYACG | Nemaline myopathy 3 |
| 794728021 | ACTA2 | NM_001613.2(ACTA2):c.116G>A (p.Arg39His) | GACRTCCAGACATCAGGTGAGG, TGTGGGACRTCCCAGACATCAGG | Thoracic aortic aneurysms and aortic dissections |
| 387906592 | ACTA2 | NM_001613.2(ACTA2):c.536G>A (p.Arg179His) | ATCATGCRTCTGGATCTGGCTGG | Aortic aneurysm, familial thoracic 6, Thoracic aortic aneurysms and aortic dissections, Multisystemic smooth muscle dysfunction syndrome, Moyamoya disease 5 |
| 112901682 | ACTA2 | NM_001141945.1(ACTA2):c.115C>T (p.Arg39Cys) | CCCATCCATTGTGGGABGTCCCA, CCATCCATTGTGGGABGTCCCAG | Aortic aneurysm, familial thoracic 6, Thoracic aortic aneurysms and aortic dissections |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515470 | ACTB | NM_001101.3(ACTB):c.349G>A (p.Glu117Lys) | CAACCGCRAGAAGAGATGACCCAG G | Baraitser-Winter syndrome 1 |
| 587779770 | ACTB | NM_001101.3(ACTB):c.220G>A (p.Gly74Ser) | GCACRGCATCGTCTCACCAACTGGG, AGCACRGCATCGTCACCAACTGG | Baraitser-Winter syndrome 1 |
| 587779769 | ACTB | NM_001101.3(ACTB):c.209C>T (p.Pro70Leu) | CCTCACCCTGAAGTACCYCATCG | Baraitser-Winter syndrome 1 |
| 587779774 | ACTB | NM_001101.3(ACTB):c.359C>T (p.Thr120Ile) | CCAACCGCGAGAAGATGAYCCA G, CCGGCGAGAAGATGAYCCAGGTG A | Baraitser-Winter syndrome 1 |
| 587779775 | ACTB | NM_001101.3(ACTB):c.446C>T (p.Thr149Ile) | CCTCTGGCCGTACCAYTGGCATC | Baraitser-Winter syndrome 1 |
| 104894546 | ACTG1 | NM_001614.3(ACTG1):c.791C>T (p.Pro264Leu) | CCGGAGGCGCTGTTCCAGCYTTC | Deafness, autosomal dominant 20 |
| 281875325 | ACTG1 | NM_001614.3(ACTG1):c.359C>T (p.Thr120Ile) | CCAACAGAGAAGATGAYTCA G | Baraitser-Winter Syndrome 2, not provided |
| 11549190 | ACTG1 | NM_001614.3(ACTG1):c.404C>T (p.Ala135Val) | CCCCGGCCATGTACGTGGYCATC, CCCGGCCATGTACGTGGYCATCC, CCGGCCATGTACGTGGYCATCCA | Baraitser-Winter Syndrome 2, not provided |
| 78001248 | ACTG2 | NM_001615.3(ACTG2):c.532C>T (p.Arg178Cys) | CCTGCCCCATGCCATCATGYGCC, CCCCATGCCCATCATGYGCCTGGA, CCCATGCCATCATGYGCCTGGAC | Visceral myopathy |
| 587777385 | ACTG2 | NM_001615.3(ACTG2):c.118C>T (p.Arg40Cys) | CCATTGTGGGCCGCCCTYGCCAC | Visceral myopathy |
| 387907345 | ACTN1 | NM_001130004.1(ACTN1): c.313G>A (p. Val105Ile) | GGCRTCAAACTGGTGTCCATCGG | Platelet-type bleeding disorder 15 |
| 794728966 | ACTN2 | NM_001103.3(ACTN2):c.2527-1G>A | CCARCCATACATCCTGGCGGAGG, TTCCCARCCATACATCCTGGCGG | Cardiomyopathy |
| 727502886 | ACTN2 | NM_001103.3(ACTN2):c.355G>A (p.Ala119Thr) | GGGCRTGAAGGTGAGAGGTGTGG, CCATTGGCRCTGAAGGTGAGAGG | Dilated cardiomyopathy 1AA, Primary familial hypertrophic cardiomyopathy, Familial hypertrophic cardiomyopathy 23 |
| 121434437 | ACVR2B | NM_001106.3(ACVR2B):c.119G>A (p.Arg40His) | CTGGAGCRCACCAACCAGAGCGG | Heterotaxy, visceral, 4, autosomal |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28936687 | ACVRL1 | NM_000020.2(ACVRL1):c.632G>A (p.Gly211Asp) | AAGRCCGCTATGGCGAAGTGTGG | Pulmonary arterial hypertension related to hereditary hemorrhagic telangiectasia |
| 28936688 | ACVRL1 | NM_000020.2(ACVRL1):c.1031G>A (p.Cys344Tyr) | CAGTRTTGCATCGCCGACCTGGG, GCAGTRTTGCATCGCCGACCTGG | Hereditary hemorrhagic telangiectasia type 2, Pulmonary arterial hypertension related to hereditary hemorrhagic telangiectasia |
| 28936401 | ACVRL1 | NM_000020.2(ACVRL1):c.1120C>T (p.Arg374Trp) | CCCGAGAGTGGGCACCAAGYGG T, CCGAGAGTGGGCACCAAGYGGT A | Hereditary hemorrhagic telangiectasia type 2, Pulmonary arterial hypertension related to hereditary hemorrhagic telangiectasia |
| 121909288 | ACVRL1 | NM_000020.2(ACVRL1):c.1450C>T (p.Arg484Trp) | CCCGACTCACCGCGCTGYGGATC, CCGACTCACCGCGCTGYGGATCA | Hereditary hemorrhagic telangiectasia type 2, Pulmonary arterial hypertension related to hereditary hemorrhagic telangiectasia |
| 121908716 | ADA | NM_000022.2(ADA):c.632G>A (p.Arg211His) | TCACCRTACTGTCCACGCCGGGG, TTCACCRTACTGTCCACGCCGGG, ATTCACCRTACTGTCCACGCCGG | Severe combined immunodeficiency due to ADA deficiency |
| 121908723 | ADA | NM_000022.2(ADA):c.646G>A (p.Gly216Arg) | CCACGCCRGGAGGTGGGCTCGG | Severe combined immunodeficiency due to ADA deficiency |
| 121908715 | ADA | NM_000022.2(ADA):c.986C>T (p.Ala329Val) | CCTTTCCAGGACATCAATGYGGC, CCAGACATCAATGYGGCCAAAT | Severe combined immunodeficiency due to ADA deficiency |
| 121908735 | ADA | NM_000022.2(ADA):c.466C>T (p.Arg156Cys) | CCATCCTGTGCTGCATGYGCCAC | Severe combined immunodeficiency due to ADA deficiency |
| 121908736 | ADA | NM_000022.2(ADA):c.226C>T (p.Arg76Trp) | CCCTTCCCAGGGGCTGCYGGGAG, CCTTCCCAGGGGCTGCYGGGAGG | Severe combined immunodeficiency due to ADA deficiency, Partial adenosine deaminase deficiency |
| 114025668 | ADA | NM_000022.2(ADA):c.643G>A (p.Ala215Thr) | CCGAGCCCACCTCCCCGGYGTGG | Severe combined immunodeficiency due to ADA deficiency, Partial adenosine deaminase deficiency |
| 121434358 | ADAMTS10 | NM_030957.3(ADAMTS10):c.73G>A (p.Ala25Thr) | ACGCACRCCTTCCGTCTCAAGG | Weill-Marchesani syndrome 1 |
| 121434357 | ADAMTS10 | NM_030957.3(ADAMTS10):c.709C>T (p.Arg237Ter) | CCTGAAGCGATCGGTCAGCYGAG | Weill-Marchesani syndrome 1 |
| 786205077 | ADAMTS13 | NM_139025.4(ADAMTS13):c.414+1G>A | GCCTGAGRTAGGCATGGAGCTGG | Upshaw-Schulman syndrome |
| 281875305 | ADAMTS13 | NM_139025.4(ADAMTS13):c.1523G>A (p.Cys508Tyr) | GGTRTATGCCAAGTGGCCCCCGG | Upshaw-Schulman syndrome, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908471 | ADAMTS 13 | NM_139025.4(ADAMTS13): c.1193G>A (p.Arg398His) | TGCTCCCRCTCCTGCGGAGGG | Upshaw-Schulman syndrome |
| 121908474 | ADAMTS 13 | NM_139025.4(ADAMTS13): c.3638G>A (p.Cys1213Tyr) | ACTRTGCAGTGGCCATTGGGCGG, CAGACTRTGCAGTGGCCATTGGG, GCAGACTRTGCAGTGGCCATTGG | Upshaw-Schulman syndrome |
| 786205078 | ADAMTS 13 | NM_139025.4(ADAMTS13): c.-331-1G>A | ACARGGGCAGAACTGCTTCGGG, CACARGGGCAGAACTGCTTCGG | Upshaw-Schulman syndrome |
| 11575933 | ADAMTS 13 | NM_139025.4(ADAMTS13): c.1423C>T (p.Pro475Ser) | CCACTGGGTGCTGCTGTAYCAC | Upshaw-Schulman syndrome |
| 121908469 | ADAMTS 13 | NM_139025.4(ADAMTS13): c.304C>T (p.Arg102Cys) | CCAGGAGGACACAGAGYGCTAT G | Upshaw-Schulman syndrome |
| 121908478 | ADAMTS 13 | NM_139025.4(ADAMTS13): c.749C>T (p.Ala250Val) | CCCAGCGGACACGTGATGGYTTC, CCAGCGGACACGTGATGGYTTCG | Upshaw-Schulman syndrome |
| 267606638 | ADAMTS 17 | NM_139057.2(ADAMTS17): c.760C>T (p.Gln254Ter) | CCACGGGGCCGAGGCCGCCYAG A | Weill-Marchesani-like syndrome |
| 137853147 | ADAMTS2 | NM_014244.4(ADAMTS2): c.2384G>A (p.Trp795Ter) | GGAGTRGGAGTACAGAGACGAG G | Ehlers-Danlos syndrome type 7, autosomal recessive |
| 137853146 | ADAMTS2 | NM_014244.4(ADAMTS2): c.673C>T (p.Gln225Ter) | CCCTCCTCTCGGGGGCCAYAGG, CCTCCTCTCGGGGGCCAYAGGC, CCTCTCGGGGGCCAYAGGCCCT | Ehlers-Danlos syndrome type 7, autosomal recessive |
| 387907064 | ADAMTSL2 | NM_001145320.1(ADAMTSL2): c.215G>A (p.Arg72Gln) | AGCRGCACTGCCTGCAGCAGAGG | Acromicric dysplasia |
| 113994121 | ADAMTSL2 | NM_001145320.1(ADAMTSL2): c.440C>T (p.Pro147Leu) | CCACATCTCCAGCAAACYGTGTG | Acromicric dysplasia |
| 387907065 | ADAMTSL2 | NM_001145320.1(ADAMTSL2): c.661C>T (p.Arg221Cys) | CCACGTGACGGGCAACTATYGCA | Acromicric dysplasia |
| 368482584 | ADAMTSL4 | NM_019032.5(ADAMTSL4): c.2008C>T (p.Arg670Ter) | CCAGTGCGTACTGAAAYGAGT | Ectopia lentis, isolated autosomal recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 119468004 | ADCK3 | NM_020247.4(ADCK3):c.1651G>A (p.Glu551Lys) | CTACRAGGTCAAGGTGAGCAGGG, GCTACRAGGTCAAGGTGAGCAGG | Coenzyme Q10 deficiency, primary, 4 |
| 119468009 | ADCK3 | NM_020247.4(ADCK3):c.1645G>A (p.Gly549Ser) | CCTCACCRGTACGAGGTCAAGG | Coenzyme Q10 deficiency, primary, 4 |
| 119468005 | ADCK3 | NM_020247.4(ADCK3):c.637C>T (p.Arg213Trp) | CCTGTGACGAGGATTGGCYGGCT | Coenzyme Q10 deficiency, primary, 4 |
| 398122981 | ADCK4 | NM_024876.3(ADCK4):c.1027C>T (p.Arg343Trp) | CCTAAGCCAGGACCTGYGGAACC | Nephrotic syndrome, type 9 |
| 587777497 | ADCY1 | NM_021116.2(ADCY1):c.3112C>T (p.Arg1038Ter) | CCCCTACCACTTTGTGTGCYGAG, CCCTACCACTTTGTGTGCYGAGG, CCTACCACTTTGTGTGCYGAGGC | Deafness, autosomal recessive 44 |
| 757156390 | ADCY5 | NM_183357.2(ADCY5):c.1425C>G (p.Ile475Met) | AGCCCTCRATGTCAGCAAACAGG | Multiple congenital anomalies |
| 796065306 | ADCY5 | NM_183357.2(ADCY5):c.2176G>A (p.Ala726Thr) | TTGACRCCAGGAGCATTGATAGG | Dyskinesia, familial, with facial myokymia |
| 587783657 | ADGRG1 | NM_005682.6(ADGRG1):c.1970G>A (p.Trp657Ter) | TCATCTRGTACTGGTCCATGCGG | Polymicrogyria, bilateral frontoparietal |
| 587783660 | ADGRG1 | NM_005682.6(ADGRG1):c.620+1G>A | GCCARTAAGTTTGGCACCTGGGG, AGCCARTAAGTTTGGCACCTGGG, CAGCCARTAAGTTTGGCACCTGG | Polymicrogyria, bilateral frontoparietal |
| 121908464 | ADGRG1 | NM_005682.6(ADGRG1):c.1693C>T (p.Arg565Trp) | CCCGCAGGTGCTGGATCYGGGAC, CCGCAGGTGCTGGATCYGGGACT | Polymicrogyria, bilateral frontoparietal |
| 587783658 | ADGRG1 | NM_005682.6(ADGRG1):c.265C>T (p.His89Tyr) | CCCAGGGGCCTCTACYACTTCT, CCCAGGGGCCTCTACYACTTCTG, CCAGGGGCCTCTACYACTTCTGC | Polymicrogyria, bilateral frontoparietal |
| 121909762 | ADGRV1 | NM_032119.3(ADGRV1):c.6901C>T (p.Gln2301Ter) | CCCTGGGGAAACCATTYAAACC, CCCTGGGGAAACCATTYAAACCT, CCTGGGGAAACCATTYAAACCTT | Usher syndrome, type 2C |
| 28941471 | ADSL | NM_000026.2(ADSL):c.569G>A (p.Arg190Gln) | TCCRAGATGACCTGCGCTTCCGG | Adenylosuccinate lyase deficiency, not provided |
| 202064195 | ADSL | NM_000026.2(ADSL):c.953C>T (p.Pro318Leu) | CCCTTGTCATGGACCYGCTACAG, CCTTGTCATGGACCYGCTACAGA | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 750614500 | ADSL | NM_000026.2(ADSL):c.56 8C>T (p.Arg19OTer) | CCAGAACTTGAAGCGTGTCYGAG | not provided |
| 756210458 | ADSL | NM_000026.2(ADSL):c.42 1C>T (p.Arg141Trp) | CCAGAGTGATCTCTYGGCTTGCC | not provided |
| 786205680 | AFF4 | NM_014423.3(AFF4):c.772 C>T (p.Arg258Trp) | CCCACTGCCTATGTGYGGCCCAT, CCACTGCCTATGTGYGGCCCATG | CHOPS SYNDROME |
| 727502823 | AFG3L2 | NM_006796.2(AFG3L2):c.1875G>A (p.Met625Ile) | AGGATRTGTATGACTTTAGGTGG, GATAGGATRTGTATGACTTTAGG | Spastic ataxia 5, autosomal recessive |
| 121434412 | AGPS | NM_003659.3(AGPS):c.926C>T (p.Thr309Ile) | CCCTGGAGTTCAGTAYTGTAGGA, CCTGGAGTTCAGTAYTGTAGGAG | Rhizomelic chondrodysplasia punctata type 3 |
| 74315283 | AGT | NM_000029.3(AGT):c.1124G>A (p.Arg375Gln) | TCTCCCCRGTAGGAGCCCTCCGG | Renal dysplasia |
| 121908522 | AGXT | NM_000030.2(AGXT):c.245G>A (p.Gly82Glu) | CTCGGRACACTGTGCCCTGGAGG, TGGCTCGGRACACTGTGCCCTGG | Primary hyperoxaluria, type I |
| 121908523 | AGXT | NM_000030.2(AGXT):c.121G>A (p.Gly41Arg) | GCCRGGGGCTGCAGATGATCGG | Primary hyperoxaluria, type I |
| 121908528 | AGXT | NM_000030.2(AGXT):c.738G>A (p.Trp246Ter) | AAGTGRCTGGCCAACTTCTGGGG, CAAGTGRCTGGCCAACTTCTGGG, TCAAGTGRCTGGCCAACTTCTGG | Primary hyperoxaluria, type I |
| 121908530 | AGXT | NM_000030.2(AGXT):c.466G>A (p.Gly156Arg) | ACCCACRGGGAGTCGTCCACCGG | Primary hyperoxaluria, type I |
| 180177161 | AGXT | NM_000030.2(AGXT):c.1079G>A (p.Arg360Gln) | GTGTGCRGATCGGCCTGCTGGG, GGTGCTGCRGATCGGCCTGCTGG | Primary hyperoxaluria, type I |
| 180177162 | AGXT | NM_000030.2(AGXT):c.107G>A (p.Arg36His) | CTCRCATCATGGCAGCCGGGGGG, CCTCRCATCATGGCAGCCGGGGG, TCCTCRCATCATGGCAGCCGGGG, CTCCTCRCATCATGGCAGCCGGG, CCTCCTCRCATCATGGCAGCCGG | Primary hyperoxaluria, type I |
| 180177163 | AGXT | NM_000030.2(AGXT):c.1102G>A (p.Ala368Thr) | CAATRCCACCCGCGAGAATGTGG | Primary hyperoxaluria, type I |
| 180177170 | AGXT | NM_000030.2(AGXT):c.125G>A (p.Gly42Glu) | CCGGGGRGCTGCAGATGATCGGG, GCCGGGGRGCTGCAGATGATCGG | Primary hyperoxaluria, type I |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 180177177 | AGXT | NM_000030.2(AGXT):c.16-1G>A | GCARATCATGGACGAGATCAAGG | Primary hyperoxaluria, type I |
| 180177196 | AGXT | NM_000030.2(AGXT):c.308G>A (p.Gly103Glu) | TTGRGGCCAATGGCATTTGGGGG, GTTGRGGCCAATGGCATTTGGGG, GGTTGRGGCCAATGGCATTTGGG, TGGTTGRGGCCAATGGCATTTGG | Primary hyperoxaluria, type I |
| 180177198 | AGXT | NM_000030.2(AGXT):c.323G>A (p.Trp108Ter) | CATTTRGGGGCCAGCCAGCCCTGG | Primary hyperoxaluria, type I |
| 180177231 | AGXT | NM_000030.2(AGXT):c.518G>A (p.Cys173Tyr) | AACTCTRCCACAGGTGAGCCTGG | Primary hyperoxaluria, type I |
| 180177235 | AGXT | NM_000030.2(AGXT):c.533G>A (p.Cys178Tyr) | GTACAAGTRCCTGCTCCTGGTGG | Primary hyperoxaluria, type I |
| 180177236 | AGXT | NM_000030.2(AGXT):c.547G>A (p.Asp183Asn) | GTGRATTCGTGGCATCCCTGGG, GGTGRATTCGTGGCATCCCTGG | Primary hyperoxaluria, type I |
| 61729604 | AGXT | NM_000030.2(AGXT):c.866G>A (p.Arg289His) | CAGCTGGCRCCAGCACCGCGAGG | Primary hyperoxaluria, type I, not provided |
| 180177210 | AGXT | NM_000030.2(AGXT):c.364C>T (p.Arg122Ter) | CCTGCACCCAGGAGCCYGAGTGC | Primary hyperoxaluria, type I |
| 180177279 | AGXT | NM_000030.2(AGXT):c.844C>T (p.Gln282Ter) | CCTGCCCTCATTGCGGAAYAGG, CCCTCATTGCGGAAYAGGTGCAT | Primary hyperoxaluria, type I |
| 180177296 | AGXT | NM_000030.2(AGXT):c.922C>T (p.Gln308Ter) | CCTGCAGGCACTGGGGCTGYAGC | Primary hyperoxaluria, type I |
| 104894325 | AICDA | NM_020661.2(AICDA):c.203G>A (p.Trp68Ter) | TCGGACTRGGACCTAGACCCTGG | Immunodeficiency with hyper IgM type 2 |
| 104894324 | AICDA | NM_020661.2(AICDA):c.70C>T (p.Arg24Trp) | CCGCTGGGCTAAGGGTYGGCGTG | Immunodeficiency with hyper IgM type 2 |
| 104894190 | AIP | NM_003977.3(AIP):c.911G>A (p.Arg304Gln) | GAGCCRAGAGCTGCAGGCCCTGG | Pituitary dependent hypercortisolism |
| 104894194 | AIP | NM_003977.3(AIP):c.40C>T (p.Gln14Ter) | CCGGGAGGACGGGATCYAAAAAC | Somatotroph adenoma, Prolactinoma, familial, Pituitary adenoma predisposition |
| 267606541 | AIP | NM_003977.3(AIP):c.241C>T (p.Arg81Ter) | CCATCGTGTGCACCATGYGAGAA | Somatotroph adenoma |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 62637014 | AIPL1 | NM_014336.4(AIPL1):c.834G>A (p.Trp278Ter) | GTGRAATGAGGCCGAGGCCAAG G | Leber congenital amaurosis 4, not provided |
| 61757484 | AIPL1 | NM_014336.4(AIPL1):c.1126C>T (p.Pro376Ser) | GACGRGGGTGGCTCTGTGGCTGG, TGGGGACGRGGGTGGCTCTGTGG | Leber congenital amaurosis 4, not specified, not provided |
| 142326926 | AIPL1 | NM_014336.4(AIPL1):c.784G>A (p.Gly262Ser) | CCCCTGCAGCCCCGCGCACYTGG, CCCTGCAGCCCCGCGCACYTGGG, CCTGCAGCCCCGCGCACYTGGGT | Leber congenital amaurosis 4, not provided |
| 137853204 | AK1 | NM_000476.2(AK1):c.118G>A (p.Gly40Arg) | TCTCCACCRGGACCTCCTCTCGG | Adenylate kinase deficiency, hemolytic anemia due to |
| 137853205 | AK1 | NM_000476.2(AK1):c.190G>A (p.Gly64Arg) | GAAGRGGCAGCTGGTTCCACTGG | Adenylate kinase deficiency, hemolytic anemia due to |
| 104894101 | AK1 | NM_000476.2(AK1):c.382C>T (p.Arg128Trp) | CCCTGAGACCATGACCCAGYGGC, CCTGAGACCATGACCCAGYGGCT | Adenylate kinase deficiency, hemolytic anemia due to |
| 121918343 | AKR1D1 | NM_005989.3(AKR1D1):c.316C>T (p.Leu106Phe) | CCCAACCCTGGAGAGGACAYTCA, CCAACCCTGGAGAGGACAYTCAG, CCCTGGAGAGGACAYTCAGGGTC | Bile acid synthesis defect, congenital, 2 |
| 121434592 | AKT1 | NM_005163.2(AKT1):c.49G>A (p.Glu17Lys) | TAGGGRAGTACATCAAGAGACCTGG | Proteus syndrome, Carcinoma of colon, Breast adenocarcinoma, Neoplasm of ovary |
| 121434593 | AKT2 | NM_001626.5(AKT2):c.821G>A (p.Arg274His) | TACCRCGACATCAAGGTTAGTGG | Diabetes mellitus type 2 |
| 387906659 | AKT2 | NM_001626.5(AKT2):c.49G>A (p.Glu17Lys) | CAGGTRAATACATCAAGAGACCTGG | |
| 397514606 | AKT3 | NM_181690.2(AKT3):c.49G>A (p.Glu17Lys) | TAGGARAATATATAAAAACTGG | Megalencephaly-polymicrogyria-polydactyly-hydrocephalus syndrome 2 |
| 121912981 | ALAD | NM_000031.5(ALAD):c.823G>A (p. Val275Met) | CTCGCCRTGTACCACGTCTCTGG | Porphobilinogen synthase deficiency |
| 121912983 | ALAD | NM_000031.5(ALAD):c.820G>A (p.Ala274Thr) | CTCRCCGTGTACCACGTCTCTGG | Porphobilinogen synthase deficiency |
| 749066913 | ALAD | NM_000031.5(ALAD):c.165-11C>T | GGTRTGGGTAGAGGGGTTGAAGG | Porphobilinogen synthase deficiency |
| 121912982 | ALAD | NM_000031.5(ALAD):c.718C>T (p.Arg240Trp) | CCCTCATCCCTTAGGACYGGGAT, CCTCATCCCTTAGGACYGGGATG | Porphobilinogen synthase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852302 | ALAS2 | NM_000032.4(ALAS2):c.871G>A (p.Gly291Ser) | ATCCAARGTATCCGTAACAGTGG | Hereditary sideroblastic anemia |
| 386834230 | ALDH1A3 | NM_000693.3(ALDH1A3):c.211G>A (p.Val71Met) | CGACRTGGACAAGGCTGTGAGG, GCCCGACRTGGACAAGGCTGTGG | not provided |
| 397514652 | ALDH1A3 | NM_000693.3(ALDH1A3):c.265C>T (p.Arg89Cys) | CCAGAGGGGCTCGCCATGGYGCC | Microphthalmia, isolated 8 |
| 28939378 | ALG1 | NM_019109.4(ALG1):c.773C>T (p.Ser258Leu) | CCCAGTCACGGAGCGGTYGGCCT, CCAGTCACGGAGCGGTYGGCCTT | Congenital disorder of glycosylation type 1K, not provided |
| 121907933 | ALG12 | NM_024105.3(ALG12):c.301G>A (p.Gly101Arg) | GTTAGARGAGTGCTTGGACTCGG | Congenital disorder of glycosylation type 1G |
| 121907931 | ALG12 | NM_024105.3(ALG12):c.200C>T (p.Thr67Met) | CCCGAGTCGTCCCCAGGAYGTT, CCGGAGTCGTCCCCAGGAYGTTC | Congenital disorder of glycosylation type 1G |
| 367570129 | ALG14 | NM_144988.3(ALG14):c.310C>T (p.Arg104Ter) | AATTCRGTGAATGTAGTATTTGG | Myasthenic syndrome, congenital, without tubular aggregates |
| 28940588 | ALG3 | NM_005787.5(ALG3):c.353G>A (p.Gly118Asp) | CCGAGRCACTGACATCCGCATGG | Congenital disorder of glycosylation type 1D |
| 387906273 | ALG3 | NM_005787.5(ALG3):c.165C>T (p.Gly55=) | CCTGCGGAGGTGGGYATCACCT | Congenital disorder of glycosylation type 1D |
| 121908294 | ALG8 | NM_024079.4(ALG8):c.824G>A (p.Gly275Asp) | GGGRCCTGTCTGTCATCATATTGG | Congenital disorder of glycosylation type 1H |
| 397514527 | ALOX12B | NM_001139.2(ALOX12B):c.1294C>T (p.Arg432Ter) | CCTCATCCCCATACCYGATACA | Autosomal recessive congenital ichthyosis 2 |
| 397514531 | ALOX12B | NM_001139.2(ALOX12B):c.1207C>T (p.His403Tyr) | CCCACCTGCTGGAGACAYACCTC, CCACCTGCTGGAGACAYACCTCA | Autosomal recessive congenital ichthyosis 2 |
| 121434233 | ALOXE3 | NM_001165960.1(ALOXE3):c.1096C>T (p.Arg366Ter) | CCTTGGGAATGAAGCTTYGAGGG | Autosomal recessive congenital ichthyosis 3 |
| 749544042 | ALPL | NM_000478.4(ALPL):c.648+1G>A | ACATTGACRTGAGTGCTCGGGGG | |
| 121918007 | ALPL | NM_000478.4(ALPL):c.571G>A (p.Glu191Lys) | AGACAACRAGATGCCCCCTGAGG | Childhood hypophosphatasia, Infantile hypophosphatasia, Adult hypophosphatasia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNA | Phenotypes |
|---|---|---|---|---|
| 121918009 | ALPL | NM_000478.4(ALPL):c.100 1G>A (p.Gly334Asp) | AAGGAGRCAGAATTGACCACGG, CAAGGAGRCAGAATTGACCACG G | Infantile hypophosphatasia |
| 121918013 | ALPL | NM_000478.4(ALPL):c.346 G>A (p.Ala116Thr) | CGCCACCRCCTACCTGTGTGGGG, CCGCCACCRCCTACCTGTGTGGG | Childhood hypophosphatasia, Infantile hypophosphatasia, Adult hypophosphatasia, Odontohypophosphatasia |
| 121918019 | ALPL | NM_000478.4(ALPL):c.526 G>A (p.Ala176Thr) | CAGRCCGCCTACGCCCACTCGG | Childhood hypophosphatasia, Infantile hypophosphatasia |
| 121918015 | ALPL | NM_000478.4(ALPL):c.323 C>T (p.Pro108Leu) | CCAATGCCCAGGTCCYTGACAGC | Odontohypophosphatasia |
| 121918020 | ALPL | NM_000478.4(ALPL):c.814 C>T (p.Arg272Cys) | CCCACTTCATCTGGAACYGCACG, CCACTTCATCTGGAACYGCACGG | Childhood hypophosphatasia, Infantile hypophosphatasia |
| 1130335 | ALPP | NM_001632.3(ALPP):c.74 C= (p.Pro25=) | CCCTGGGCATCATCCYAGGTAAT, CCTGGGCATCATCCYAGGTAATG | |
| 587776684 | ALX1 | NM_066982.2(ALX1):c.53 1+1G>A | TCCAGRTAGGAGCCAAAAAGAG G | Frontonasal dysplasia 3 |
| 121908168 | ALX3 | NM_066492.2(ALX3):c.54 7C>T (p.Arg183Trp) | CCTGATGTGTATGCCYGGGAGCA | Frontonasal dysplasia 1 |
| 387907269 | AMER1 | NM_152424.3(AMER1):c.8 11C>T (p.Gln271Ter) | CCTCAGCACATGTGYAACCCAAG | Osteopathia striata with cranial sclerosis |
| 121912682 | AMPD1 | NM_000036.2(AMPD1):c.1 373G>A (p.Arg458His) | GAGCCCCRCCTGTCCATCTATGG | Muscle AMP deaminase deficiency, not provided |
| 121964981 | AMT | NM_000481.3(AMT):c.806 G>A (p.Gly269Asp) | AGGGCAGRCCTCTGCCTGTATGGG, GAGGCAGRCCTCTGCCTGTATGG | Non-ketotic hyperglycinemia |
| 36210415 | ANK2 | NM_001127493.1(ANK2):c. 1360G>A (p.Gly454Arg) | CCGAGGCCRGGCAGGTGGAAGTG G | Torsades de pointes |
| 1800497 | ANKK1 | NM_178510.1(ANKK1):c.2 137G>A (p.Glu713Lys) | CCAGCTGGGCGCCTGCCTYGACC | Dopamine receptor d2, reduced brain density of |
| 137852512 | ANOS1 | NM_000216.2(ANOS1):c.7 11G>A (p.Trp237Ter) | TCACTGRCAGACAGTGGCCCAGG | Kallmann syndrome 1 |
| 137852514 | ANOS1 | NM_000216.2(ANOS1):c.7 74G>A (p.Trp258Ter) | CCGATGRTACCAGTTTCGAGTGG | Kallmann syndrome 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852516 | ANOS1 | NM_000216.2(ANOS1):c.784C>T (p.Arg262Ter) | CCGATGGTACCAGTTTYGAGTGG | Kallmann syndrome 1 |
| 137852517 | ANOS1 | NM_000216.2(ANOS1):c.1187C>T (p.Ser396Leu) | CCCTTCACTTCACATYGACACAT, CCTTCACTTCACATYGACACATG | Kallmann syndrome 1 |
| 397514700 | ANTXR1 | NM_032208.2(ANTXR1):c.505C>T (p.Arg169Ter) | CCCAGGCTAATAGGTTCTYGAGAT, CCAGGCTAATAGGTCTYGAGATC | Odontotrichomelic syndrome |
| 587776739 | AP1S2 | NM_003916.4(AP1S2):c.288+5G>A | CCTAAAATAAAATACTAYTCACA | Mental retardation X-linked syndromic 5 |
| 397514498 | AP2S1 | NM_044069.4(AP2S1):c.43C>T (p.Arg15Cys) | CCGGGCAGGCAAGACGYGCCTGG | Hypocalciuric hypercalcemia, familial, type 3 |
| 730882249 | AP4M1 | NM_004722.3(AP4M1):c.952C>T (p.Arg318Ter) | CCAGGTTTATCTAAAGTTGYGAT | Microcephaly, Hypoplasia of the corpus callosum, Spastic paraplegia 50, autosomal recessive, Global developmental delay, CNS hypomyelination, Brain atrophy |
| 587781392 | APC | NM_000038.5(APC):c.637C>T (p.Arg213Ter) | CCAGGATATGGAAAAAYGAGCAC | Hereditary cancer-predisposing syndrome, not provided |
| 121913327 | APC | NM_000038.5(APC):c.4012C>T (p.Gln1338Ter) | CCAAATCCAGCAGACTGYAGGGT | Familial adenomatous polyposis 1, Carcinoma of colon |
| 587783029 | APC | NM_000038.5(APC):c.3286C>T (p.Gln1096Ter) | CCAACCACATTTTGACAGYAGG, CCACATTTTGACAGYAGGAAATG | Familial adenomatous polyposis 1, not provided |
| 121909576 | APOA4 | NM_000482.3(APOA4):c.748G>A (p.Glu250Lys) | ACGCCRAGGAGCTCAAGGCCAGG | |
| 121918390 | APOB | NM_000384.2(APOB):c.7564C>T (p.Arg2522Ter) | CCTAGAAGATACACGAGACYGAA | Hypobetalipoproteinemia, familial, associated with apob32 |
| 138326449 | APOC3 | NM_000040.1(APOC3):c.55+1G>A | TCTGCCCRTAAGCACTTGGTGGG, CTCTGCCCRTAAGCACTTGGTGG | Coronary heart disease, Hyperalphalipoproteinemia 2 |
| 28931577 | APOE | NM_000041.3(APOE):c.349G>A (p.Ala117Thr) | CAGRCGGCGCAGGCCCGGCTGGG, GCAGRCGGCGCAGGCCCGGCTGG, AGCTGCAGRCGGCGCAGGCCCGG | |
| 121918398 | APOE | NM_000041.3(APOE):c.875G>A (p.Arg292His) | GCAGRCCCAGTGGGCCGGCTGG | |
| 267606664 | APOE | NM_000041.3(APOE):c.434G>A (p.Gly145Asp) | CATGCTCGRCCAGAGCACCGAGG | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 7412 | APOE | NM_000041.2(APOE):c.52 6C>T (p.Arg176Cys) | CCGATGACCTGCAGAAGYGCTG | Familial type 3 hyperlipoproteinemia |
| 769455 | APOE | NM_000041.3(APOE):c.48 7C>T (p.Arg163Cys) | CCCACCTGCGCAAGCTGYGTAAG, CCACCTGCGCAAGCTGYGTAAGC | Familial type 3 hyperlipoproteinemia |
| 387906567 | APOE | NM_000041.3(APOE):c.47 8C>T (p.Arg160Cys) | CCTCGCCTCCCACCTGYGCAAGC | Familial type 3 hyperlipoproteinemia |
| 63749810 | APP | NM_000484.3(APP):c.2080 G>A (p.Asp694Asn) | GAARATGTGGGTTCAAACAAAGG | Cerebral amyloid angiopathy, APP-related, not provided |
| 63750734 | APP | NM_000484.3(APP):c.2143 G>A (p. Val715Met) | GACARTGATCGTCATCACCTTGG | Alzheimer disease, type 1, not provided |
| 104894507 | APRT | NM_000485.2(APRT):c.29 4G>A (p.Trp98Ter) | TCTGTGRGCCTCCTATTCCCTGG | Adenine phosphoribosyltransferase deficiency |
| 121908131 | APTX | NM_175073.2(APTX):c.61 7C>T (p.Pro206Leu) | CCATTGGCTGGTCTTACYGTGGA | Adult onset ataxia with oculomotor apraxia |
| 104894004 | AQP1 | NM_198098.2(AQP1):c.113 C>T (p.Pro38Leu) | CCCTGGGCTTCAAATACCYGGTG, CCTGGGCTTCAAATACCYGGTGG | |
| 368292687 | AQP5 | NM_001651.3(AQP5):c.562 C>T (p.Arg188Cys) | CCATGAACCCAGCCYGCTCTTTT | Diffuse palmoplantar keratoderma, Bothnian type |
| 104894742 | AR | NM_000044.3(AR):c.4G>A (p.Glu2Lys) | ATGRAAGTGCAGTTAGGGCTGGG, GATGRAAGTGCAGTTAGGGCTGG, CAAGGATGRAAGTGCAGTTAGGG | Reifenstein syndrome |
| 137852563 | AR | NM_000044.3(AR):c.2157 G>A (p. Trp719Ter) | AAGTGRGCCAAGGCCTTGCCTGG | |
| 137852571 | AR | NM_000044.3(AR):c.2191 G>A (p.Val731Met) | CTTACACRTGGACGACCAGATGG | Malignant tumor of prostate |
| 137852572 | AR | NM_000044.3(AR):c.2324 G>A (p.Arg775His) | GGTACCRCATGCACAAGTCCCGG | |
| 137852583 | AR | NM_000044.3(AR):c.2164 G>A (p.Ala722Thr) | GGCCAAGRCCTTGCCTGGTAAGG | Malignant tumor of prostate |
| 137852588 | AR | NM_000044.3(AR):c.1645 C>T (p.Pro549Ser) | CCAGGGACCATGTTTTGYCCATT | Hypospadias 1, X-linked |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28940281 | ARHGEF10 | NM_014629.3(ARHGEF10):c.995C>T (p.Thr332Ile) | CCGCGAAGGACGGCAYCAAGGAC | Slowed nerve conduction velocity, autosomal dominant |
| 587779745 | ARID1B | NM_020732.3(ARID1B):c.4102C>T (p.Gln1368Ter) | CCAGCCCGGCCTGTACCCAYAGC, CCCGGCCTGTACCCAYAGCAGCC, CCGGCCTGTACCCAYAGCAGCCG | Coffin Siris/Intellectual Disability |
| 387907140 | ARID1B | NM_020732.3(ARID1B):c.3919C>T (p.Gln1307Ter) | CCCACACAGCAGCATGYAGGACAT, CCAACAGCAGCATGYAGGACATG | Mental retardation, autosomal dominant 12 |
| 387907141 | ARID1B | NM_020732.3(ARID1B):c.3304C>T (p.Arg1102Ter) | CCCCTGGACCTGTTCYGACTCTA, CCCTGGACCTGTTCYGACTCTAC | Mental retardation, autosomal dominant 12 |
| 369721476 | ARMC5 | NM_001288767.1(ARMC5):c.1084C>T (p.Arg362Ter) | CCCTCCTGGAACTCAGCYGAGGC, CCTCCTGGAACTCAGCYGAGGCT | Acth-independent macronodular adrenal hyperplasia 2 |
| 199476366 | ARSA | NM_000487.5(ARSA):c.737G>A (p.Arg246His) | TTCAGGCCRCGGGCCATTTGGGG | Metachromatic leukodystrophy, not provided |
| 74315461 | ARSA | NM_000487.5(ARSA):c.370G>A (p.Gly124Ser) | GGCCRGCAAGTGGCACCTTGGGG, TGGCCRGCAAGTGGCACCTTGGG, ATGGCCRGCAAGTGGCACCTTGG | Metachromatic leukodystrophy, not provided |
| 80338815 | ARSA | NM_000487.5(ARSA):c.465+1G>A | CGACCAGRTAGGAACCACCCGGG, ACGACCAGRTAGGAACCACCCGG | Metachromatic leukodystrophy, Metachromatic leukodystrophy, juvenile type, Metachromatic leukodystrophy, adult type |
| 80338820 | ARSA | NM_000487.5(ARSA):c.1210+1G>A | CCCAGGRTAACCCCTCCCCCTGG | Metachromatic leukodystrophy, Metachromatic leukodystrophy, juvenile type |
| 74315458 | ARSA | NM_000487.5(ARSA):c.257G>A (p.Arg86Gln) | GTTCRGATGGGCATGTACCCTGG | Metachromatic leukodystrophy |
| 74315483 | ARSA | NM_000487.5(ARSA):c.763G>A (p.Glu255Lys) | ATGRAGCTGATGCAGCTGTGGG, GATGRAGCTGATGCAGCTGTGG | Metachromatic leukodystrophy, Metachromatic leukodystrophy, late infantile |
| 74315456 | ARSA | NM_000487.5(ARSA):c.293C>T (p.Ser98Phe) | CCTGGTGCCCAGCTYCCGGGGGG | Metachromatic leukodystrophy, Metachromatic leukodystrophy, late infantile |
| 74315462 | ARSA | NM_000487.5(ARSA):c.413C>T (p.Pro138Leu) | CCTGAGGGGGCCTTCCTGCYCCCC | Metachromatic leukodystrophy |
| 398123418 | ARSA | NM_000487.5(ARSA):c.986C>T (p.Thr329Ile) | CCTGCCCCAGGCGTGAYCCACG | Metachromatic leukodystrophy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 74315468 | ARSA | NM_000487.5(ARSA):c.67 7C>T (p.Ala226Val) | CCCTTCTTCCTGTACTATGYCTC, CCTTCTTCCTGTACTATGYCTCT | Metachromatic leukodystrophy |
| 74315473 | ARSA | NM_000487.5(ARSA):c.86 8C>T (p.Arg290Cys) | CCCAGACCTGAGACCATGYGTAT, CCAGACCTGAGACCATGYGTATG | Metachromatic leukodystrophy |
| 74315481 | ARSA | NM_000487.5(ARSA):c.12 32C>T (p.Thr411Ile) | CCACAGTGATACCAYTGCAGAC, CCACAGTGATACCAYTGCAGACC | Metachromatic leukodystrophy |
| 118203941 | ARSB | NM_000046.3(ARSB):c.12 14G>A (p.Cys405Tyr) | CCCAGRTCCCAGGAACAGCATGG | Mucopolysaccharidosis type VI, MUCOPOLYSACCHARIDOSIS, TYPE VI, SEVERE |
| 118203942 | ARSB | NM_000046.3(ARSB):c.28 4G>A (p.Arg95Gln) | TCGCRGAGCCAGCTGCTCACTGG | Mucopolysaccharidosis type VI, not provided |
| 122460155 | ARSE | NM_000047.2(ARSE):c.14 75G>A (p.Cys492Tyr) | CGGTGCCTRCTATGGAAGAAAGG | Chondrodysplasia punctata 1, X-linked recessive |
| 28935474 | ARSE | NM_000047.2(ARSE):c.17 32C>T (p.Pro578Ser) | CCCTGTGTGGCCCGTTCYCCCT, CCTGCTGTGGCCCCGTTCYCCCTC | Chondrodysplasia punctata 1, X-linked recessive |
| 587783096 | ARX | NM_139058.2(ARX):c.114 1G>A (p.Ala381Thr) | TCGGRCCAAGTGGCCAAGCGGG, GTCGGRCCAAGTGGCGCAAGCGG | not provided |
| 104894740 | ARX | NM_139058.2(ARX):c.111 7C>T (p.Gln373Ter) | CCGAGGCCCGAGTCYAGGTGAGC | Lissencephaly 2, X-linked |
| 104894743 | ARX | NM_139058.2(ARX):c.105 8C>T (p.Pro353Leu) | CCAGAAGACGCACTACCYGGAC G | Epileptic encephalopathy, early infantile, 1 |
| 587783189 | ARX | NM_139058.2(ARX):c.141 4C>T (p.Arg472Ter) | CCTCCGAGCCGCAGTGTTCYGAC | Lissencephaly 2, X-linked |
| 145873635 | ASAH1 | NM_044315.4(ASAH1):c.1 73C>T (p.Thr58Met) | ACTCACARTTGGTCCTGAAGGAGG | Jankovic Rivera syndrome |
| 104886478 | ASB10 | NM_080871.3(ASB10):c.76 5C>T (p.Thr255=) | CCGATGCCGAGGCCACCACYGCC | Glaucoma 1, open angle, F |
| 145138923 | ASL | NM_000048.3(ASL):c.35G >A (p.Arg12Gln) | TGGCRGTTTGTGGGTGCAGTGG | Argininosuccinate lyase deficiency, not provided |
| 142637046 | ASL | NM_000048.3(ASL):c.446+ 1G>A | GCAGAGGCRTGAGTCCTACAGGG | not provided |
| 28940286 | ASL | NM_001024943.1(ASL):c.1 153C>T (p.Arg385Cys) | CCCAGATGCCATTCYGCCAGGCC | Argininosuccinate lyase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123126 | ASL | NM_000048.3(ASL):c.544 C>T (p.Arg182Ter) | CCACGCCGTGGCACTGACCYGAG, CCGTGGCACTGACCYGAGACTCT | Argininosuccinate lyase deficiency, not provided |
| 374304304 | ASL | NM_000048.3(ASL):c.280 C>T (p.Arg94Cys) | CCACACAGCCAATGAGYGCCGCC | Argininosuccinate lyase deficiency, not provided |
| 398122974 | ASNS | NM_183356.3(ASNS):c.16 48C>T (p.Arg550Cys) | CCACTGACCCTTCTGCCYGCACG | Asparagine synthetase deficiency, Abnormality of neuronal migration |
| 199422154 | ASPM | NM_018136.4(ASPM):c.30 82G>A (p.Gly1028Arg) | GCATRTGTAAAAACTGAGTAGAGG | Primary autosomal recessive microcephaly 5 |
| 587783287 | ASPM | NM_018136.4(ASPM):c.90 91C>T (p.Arg3031Ter) | CCTTATAGAGACATYGAGCTGCT | Primary autosomal recessive microcephaly 5 |
| 587783227 | ASPM | NM_018136.4(ASPM):c.27 91C>T (p.Arg931Ter) | CCTTTTGGCTTTTTCAYGAGATT | Primary autosomal recessive microcephaly 5 |
| 587783275 | ASPM | NM_018136.4(ASPM):c.80 17C>T (p.Gln2673Ter) | CCAAGCAGTTATTGTATAYAGT | Primary autosomal recessive microcephaly 5 |
| 199422148 | ASPM | NM_018136.4(ASPM):c.19 90C>T (p.Gln664Ter) | CCCATTATCGCTGTGGCAYAGTC, CCATTATCGCTGTGCAYAGTCC | Primary autosomal recessive microcephaly 5 |
| 199422175 | ASPM | NM_018136.4(ASPM):c.78 94C>T (p.Gln2632Ter) | CCAGGCTGCCATTATTATTYAGA | Primary autosomal recessive microcephaly 5 |
| 137852996 | ASPM | NM_018136.4(ASPM):c.34 9C>T (p.Arg117Ter) | CCACTCAAAGAAGGCYGAGTAA G | Primary autosomal recessive microcephaly 5 |
| 121908637 | ASS1 | NM_000050.4(ASS1):c.470 G>A (p.Arg157His) | CAAGGGCCRCAATGACCTGATGG | Citrullinemia type I, not provided |
| 121908639 | ASS1 | NM_000050.4(ASS1):c.970 G>A (p.Gly324Ser) | TACCRGTGCCTAAGACTCTATGG | Citrullinemia type I, not provided |
| 777828000 | ASS1 | NM_000050.4(ASS1):c.571 G>A (p.Glu191Lys) | CAGCTACRAGGCTGGAATCCTGG | Citrullinemia type I |
| 398123131 | ASS1 | NM_000050.4(ASS1):c.794 G>A (p.Arg265His) | CGTGGGCCRTATTGACATCGTGG | Citrullinemia type I, not provided |
| 786204537 | ASS1 | NM_000050.4(ASS1):c.103 0C>T (p.Arg344Ter) | CCAAGTCCCAGGAGYGAGTGGA A | Citrullinemia type I, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 138350285 | ASS1 | NM_000050.4(ASS1):c.-4C>T | CCTCGACTCCCGCCAGAYGCTAT | not provided |
| 121908640 | ASS1 | NM_000050.4(ASS1):c.1087C>T (p.Arg363Trp) | CCAGTGTACATCCTCGGCYGGG | Citrullinemia type I, not provided |
| 121908642 | ASS1 | NM_000050.4(ASS1):c.910C>T (p.Arg304Trp) | CCTTCACCATGGACYGGGAAGTG | Citrullinemia type I |
| 373145711 | ASXL1 | NM_015338.5(ASXL1):c.1210C>T (p.Arg404Ter) | CCAGCCACCCGACAGYGAGATG G | C-like syndrome |
| 387907077 | ASXL1 | NM_015338.5(ASXL1):c.2773C>T (p.Gln925Ter) | CCATCTGTTGAGCCCYAGGTTGG | C-like syndrome |
| 587777061 | ASXL3 | NM_030632.1(ASXL3):c.1210C>T (p.Gln404Ter) | CCTTGGCAGAACAAYAGCCAAA A | Bainbridge-Ropers syndrome |
| 761357250 | ATF6 | NM_007348.3(ATF6):c.970C>T (p.Arg324Cys) | CCGCTTGTCAGTCTYGCAAGAAG | Achromatopsia 7 |
| 119476046 | ATL1 | NM_015915.4(ATL1):c.715C>T (p.Arg239Cys) | CCAAATTCTTGGAAAAAYGCCTC | Spastic paraplegia 3 |
| 137852657 | ATL1 | NM_015915.4(ATL1):c.467C>T (p.Thr156Ile) | CCTTTGATAGTCAGTCAAYTTTG | Spastic paraplegia 3 |
| 587779818 | ATM | NM_000051.3(ATM):c.170G>A (p.Trp57Ter) | TGAATTRGGATGCTGTTTTTAGG | Ataxia-telangiectasia syndrome, Hereditary cancer-predisposing syndrome |
| 786201957 | ATM | NM_000051.3(ATM):c.3349C>T (p.Gln1117Ter) | CCTTTGAAGCTTCAGYAAACAGC | Hereditary cancer-predisposing syndrome |
| 199624796 | ATP13A2 | NM_022089.3(ATP13A2):c.490C>T (p.Arg164Trp) | ATACCRCAGCACCCCTTCTGGG, AATACCRCAGCACCCGCTTCTGG | Parkinson disease 9 |
| 121918616 | ATP1A2 | NM_000702.3(ATP1A2):c.1643G>A (p.Arg548His) | GGGAGCRTGTGCTGGGTGAGAGG | Migraine, familial basilar |
| 796052276 | ATP1A2 | NM_000702.3(ATP1A2):c.1091C>T (p.Thr364Met) | CCTGGAGGCGGTGGAGAYGCTG G | not provided |
| 121918615 | ATP1A2 | NM_000702.3(ATP1A2):c.2936C>T (p.Pro979Leu) | CCCTCCGATGTACCYGCTCAAG, CCTCCGCATGTACCYGCTCAAGT | Familial hemiplegic migraine type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918620 | ATP1A2 | NM_000702.3(ATP1A2):c.1127C>T (p.Thr376Met) | CCATCTGCTCGGACAAGAYGGGC | Familial hemiplegic migraine type 2 |
| 80356534 | ATP1A3 | NM_152296.4(ATP1A3):c.1838C>T (p.Thr613Met) | CCGGCGATCACCCCATCAYGGCC | Dystonia 12 |
| 121918113 | ATP2A1 | NM_004320.4(ATP2A1):c.592C>T (p.Arg198Ter) | CCCGTTCCTGACCCCYGAGCTGT, CCGTTCCTGACCCCYGAGCTGTC | Brody myopathy |
| 121918115 | ATP2A1 | NM_004320.4(ATP2A1):c.2366C>T (p.Pro789Leu) | CCTGAGGCCCTGATCCYGGTGCA | Brody myopathy |
| 121912736 | ATP2A2 | NM_001681.3(ATP2A2):c.2305G>A (p.Gly769Arg) | CGTCRGGGAAGTTGTCTGGTAGG, CCAACGTCRGGGAAGTTGTCTGG | Darier disease, segmental |
| 28929478 | ATP2A2 | NM_001681.3(ATP2A2):c.68G>A (p.Gly23Glu) | TACGRGCTGAGCCTGGAACAGG | Keratosis follicularis |
| 137853012 | ATP2C1 | NM_001001486.1(ATP2C1):c.910G>A (p.Ala304Thr) | GCTGTARCAGCAATTCCTGAAGG | Familial benign pemphigus |
| 121918521 | ATP6AP2 | NM_005765.2(ATP6AP2):c.321C>T (p.Asp107=) | CCTTTTAGTCTTGAYAGTGTTGC | Mental retardation, X-linked, syndromic, Hedera type |
| 374480381 | ATP6V0A2 | NM_012463.3(ATP6V0A2):c.1514+1G>A | GGAARTAAGTGTCCCATAGCTGG | Cutis laxa with osteodystrophy, not provided |
| 28939081 | ATP6V0A4 | NM_020632.2(ATP6V0A4):c.2420G>A (p.Arg807Gln) | TGCRACTGCACTGGTAAGGATGG, GCCCTGCRACTGCACTGGTAAGG | Renal tubular acidosis, distal, autosomal recessive, with late-onset sensorineural hearing loss |
| 121908367 | ATP6V0A4 | NM_020632.2(ATP6V0A4):c.2257C>T (p.Gln753Ter) | CCTCAGCCTGGCTCATGCAYGTG | Renal tubular acidosis, distal, autosomal recessive |
| 121908368 | ATP6V0A4 | NM_020632.2(ATP6V0A4):c.1571C>T (p.Pro524Leu) | CCCGTTTGGGATTGATCYGGTAA, CCGTTTGGGATTGATCYGGTAAT | Renal tubular acidosis, distal, autosomal recessive |
| 121964881 | ATP6V1B1 | NM_001692.3(ATP6V1B1):c.232G>A (p.Gly78Arg) | GAGRCGGCAGGTGCTTGAGGTGG, GAGGAGCRGGCAGGTGCTTGAGG | |
| 794729667 | ATP6V1B2 | NM_001693.3(ATP6V1B2):c.1516C>T (p.Arg506Ter) | CCTCAGCGGAATTTACCCTYGAG | Zimmermann-Laband syndrome 2 |
| 267606673 | ATP7A | NM_000052.6(ATP7A):c.2981C>T (p.Thr994Ile) | CCAAGCCTCTATCAYAGTTCTGT | Distal spinal muscular atrophy, X-linked 3 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 201038679 | ATP7B | NM_000053.3(ATP7B):c.2975C>T (p.Pro992Leu) | CGTGRGCGTGGCCAGCCCCAGGG, CCGTGRGCGTGGCCAGCCCCAGG | Wilson disease |
| 28942076 | ATP7B | NM_000053.3(ATP7B):c.2827G>A (p.Gly943Ser) | GTAATCRGTTTTATCGATTTTGG | Wilson disease |
| 137853283 | ATP7B | NM_000053.3(ATP7B):c.2336G>A (p.Trp779Ter) | GGGCCGGTRGCTGAACACTTGG | Wilson disease |
| 587783306 | ATP7B | NM_000053.3(ATP7B):c.2865+1G>A | TCCTRTAAGTTGAATGCCTTGGG, TTCCTRTAAGTTGAATGCCTTGG | Wilson disease |
| 72552255 | ATP7B | NM_000053.3(ATP7B):c.2930C>T (p.Thr977Met) | CCCGGAACCCAAGTTCRTCACGTT | Wilson disease, not provided |
| 121907994 | ATP7B | NM_000053.3(ATP7B):c.2621C>T (p.Ala874Val) | CCCGGAAGCACTGTAATTGYGGG, CCGGAAGCACTGTAATTGYGGGG | Wilson disease |
| 121909101 | ATP8B1 | NM_005603.4(ATP8B1):c.1660G>A (p.Asp554Asn) | CTCTCCCRATGAAGGTGCCCTGG | Progressive intrahepatic cholestasis |
| 122445104 | ATRX | NM_000489.4(ATRX):c.5225G>A (p.Arg1742Lys) | AGGARGAGGATTATTTTAACAGG | ATR-X syndrome |
| 122445099 | ATRX | NM_000489.4(ATRX):c.7156C>T (p.Arg2386Ter) | CCAGGAGCTTGATGTTAAAYGAA | ATR-X syndrome |
| 730880309 | AUH | NM_001698.2(AUH):c.895-1G>A | CTCARGTCGATTTAGTAACAGGG, TCTCARGTCGATTTAGTAACAGG | 3-Methylglutaconic aciduria |
| 121908654 | AURKC | NM_001015879.1(AURKC):c.629G>A (p.Cys210Tyr) | CTCTRCTATGAGCTGCTGGTGGG, GCTCTRCTATGAGCTGCTGGTGG, AGTGCTCTRCTATGAGCTGCTGG | Infertility associated with multi-tailed spermatozoa and excessive DNA |
| 121964882 | AVP | NM_000490.4(AVP):c.262G>A (p.Gly88Ser) | AGTCCRGCCAGAAGGCGTGCGGG, CAGTCCRGCCAGAAGGCGTGCGG | Neurohypophyseal diabetes insipidus |
| 121964890 | AVP | NM_000490.4(AVP):c.260C>T (p.Ser87Phe) | CCGTCGCCCTGCCAGTYCGGCCA | Neurohypophyseal diabetes insipidus |
| 121964892 | AVP | NM_000490.4(AVP):c.20C>T (p.Pro7Leu) | CCTGACACCATGCTGCYCGCCTG | |
| 28935496 | AVPR2 | NM_000054.4(AVPR2):c.337C>T (p.Arg113Trp) | CCAGATGCCCTGTGTYGGGCCGT | Nephrogenic diabetes insipidus, X-linked |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894760 | AVPR2 | NM_000054.4(AVPR2):c.310C>T (p.Arg104Cys) | CCTGGAAGGCCACCGACYGCTTC | Nephrogenic diabetes insipidus, Nephrogenic diabetes insipidus, X-linked |
| 730882193 | AXIN2 | NM_004655.3(AXIN2):c.1989G>A (p.Trp663Ter) | ATCTGTGRGGGGCAACAGCGGG, CATCTGTGRGGGGCAACAGCGG | Oligodontia-colorectal cancer syndrome |
| 121908568 | AXIN2 | NM_004655.3(AXIN2):c.1966C>T (p.Arg656Ter) | CCGCTCGTCTCCAGCGAAYGAG | Oligodontia-colorectal cancer syndrome |
| 367543074 | B3GALNT2 | NM_152490.4(B3GALNT2):c.802G>A (p.Val268Met) | GGTRTGGAGGGAGTTGCAGTGG, GAAGGTRTGGAGGGAGTTGCAG G | Congenital muscular dystrophy-dystroglycanopathy with brain and eye anomalies, type A11, not provided |
| 397514722 | B3GALT6 | NM_080605.3(B3GALT6):c.16C>T (p.Arg6Trp) | CGCCCRCCGCAGCAGCTTCATGG | Ehlers-Danlos syndrome, progeroid type, 2 |
| 397514724 | B3GALT6 | NM_080605.3(B3GALT6):c.649G>A (p.Gly217Ser) | CCGAGAGCACGTAGCYGCCCCC | |
| 387906876 | BAG3 | NM_004281.3(BAG3):c.1430G>A (p.Arg477His) | GTGCRTCAGGCCAGGAGAGACG G | Dilated cardiomyopathy 1HH |
| 387906874 | BAG3 | NM_004281.3(BAG3):c.211C>T (p.Arg71Trp) | CCAATGGCCCTTCCYGGGAGGGC | Dilated cardiomyopathy 1HH, not provided |
| 387906871 | BANF1 | NM_003860.3(BANF1):c.34G>A (p.Ala12Thr) | CTTCGTGRCAGAGCCCATGGGGG, ACTTCGTGRCAGAGCCCATGGGG | Nestor-Guillermo progeria syndrome |
| 786202118 | BARD1 | NM_000465.3(BARD1):c.2268G>A (p.Trp756Ter) | TCTGRAAGGCTCCTTCGAGCTGG | Hereditary cancer-predisposing syndrome |
| 587777829 | BBS1 | NM_024649.4(BBS1):c.432+1G>A | AAGAGRTAAATAAATAACATGG, AAAGAGRTAAATAAATAACATG G | Bardet-Biedl syndrome, Bardet-Biedl syndrome 1 |
| 121908178 | BBS2 | NM_031885.3(BBS2):c.943C>T (p.Arg315Trp) | CCTTCTGTTCAGTCYGGGGCTAC | |
| 121908180 | BBS2 | NM_031885.3(BBS2):c.646C>T (p.Arg216Ter) | CCCATGTATGGCAGTYGATTTGG, CCATGTATGGCAGTYGATTTGGT | |
| 119466002 | BBS7 | NM_176824.2(BBS7):c.632C>T (p.Thr211Ile) | CCTTTTGTTTGGGAYATCAGACG | Bardet-Biedl syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918133 | BCAM | NM_005581.4(BCAM):c.36 1C>T (p.Arg12lTer) | CCCAGGTGGGCGACGAGYGAGA C, CCAGGTGGGCGACGAGYGAGAC T | |
| 375785084 | BCKDHA | NM_000709.3(BCKDHA):c. 659C>T (p.Ala220Val) | CCTCAGCCGTGGGGGCGGYGTA | Maple syrup urine disease, not provided |
| 398123497 | BCKDHA | NM_000709.3(BCKDHA):c. 288+9C>T | CCCCCACGTGAGAGGYGGCCTCC, CCCCACGTGAGAGGYGGCCTCCC | Maple syrup urine disease, not provided |
| 398123503 | BCKDHA | NM_000709.3(BCKDHA):c. 632C>T (p.Thr211Met) | CCTCCCACTGGCCAYGCAGATC | Maple syrup urine disease, not provided |
| 137852873 | BCKDHA | NM_000709.3(BCKDHA):c. 793C>T (p.Arg265Trp) | CCCATCATCTTCTTCTGCYGGA, CCCATCATCTTCTTCTGCYGGAA, CCATCATCTTCTTCTGCYGGAAC | Maple syrup urine disease type 1A |
| 398124602 | BCKDHB | NM_000056.3(BCKDHB):c. 952-1G>A | TTCARTCTGTGATCAAAACAGGG, TTTCARTCTGTGATCAAAACAGG | Maple syrup urine disease, not provided |
| 121965004 | BCKDHB | NM_000056.3(BCKDHB):c. 616C>T (p.His206Tyr) | CCTGAAGCATTTTTTGCCYATTG | |
| 397514573 | BCKDK | NM_005881.3(BCKDK):c.4 66C>T (p.Arg156Ter) | CCAGTACTGCCAGCTGGTGYGAC | Branched-chain ketoacid dehydrogenase kinase deficiency |
| 121908571 | BCS1L | NM_004328.4(BCS1L):c.83 0G>A (p.Ser277Asn) | GCAGARCCTGGTACTCCTGGAGG, GCAGCAGARCCTGGTACTCCTGG | Mitochondrial complex III deficiency |
| 121908578 | BCS1L | NM_004328.4(BCS1L):c.55 0C>T (p.Arg184Cys) | CCCTTTGGCTATCCACGCYGCCG, CCTTTGGCTATCCACGCYGCCGG | Mitochondrial complex III deficiency |
| 28940276 | BEST1 | NM_004183.3(BEST1):c.25 G>A (p.Val9Met) | CAARTGGCTAATGCCCGCTTAGG | Vitelliform dystrophy, not provided |
| 121918287 | BEST1 | NM_004183.3(BEST1):c.94 9G>A (p. Val317Met) | CCAGRTGTCCCTGTTGGCTGTGG | Bestrophinopathy, autosomal recessive |
| 28940570 | BEST1 | NM_004183.3(BEST1):c.72 8C>T (p.Ala243Val) | CCCAGGTGGTGACTGTGGYGGTG, CCAGGTGGTGACTGTGGYGGTGT | Vitelliform dystrophy, not provided |
| 372989281 | BEST1 | NM_004183.3(BEST1):c.76 3C>T (p.Arg255Trp) | CCTGACTTGTCTAGTTGGGYGGC | Retinitis pigmentosa |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123028 | BICD2 | NM_015250.3(BICD2):c.320C>T (p.Ser107Leu) | CCTGATCCAGGAGTYGGCCTCCA | Spinal muscular atrophy, lower extremity predominant 2, autosomal dominant |
| 587783343 | BIN1 | NM_139343.2(BIN1):c.1713G>A (p.Trp571Ter) | CTGRAACCAGCACAAGGAGCTGG | Autosomal recessive centronuclear myopathy |
| 55758736 | BLK | NM_001715.2(BLK):c.211G>A (p.Ala71Thr) | CTACACCRCTATGAATGATCGGG, ACTACACCRCTATGAATGATCGG | Maturity-onset diabetes of the young, type 11, not specified |
| 367543025 | BLM | NM_000057.3(BLM):c.3197G>A (p.Cys1066Tyr) | TGATAATTRCTGTAAAACAAAGG | Bloom syndrome |
| 104894763 | BMP15 | NM_005448.2(BMP15):c.202C>T (p.Arg68Trp) | CCTAGGGCATTCACTGYGGTACA | Premature ovarian failure 4 |
| 137853320 | BMP15 | NM_005448.2(BMP15):c.631C>T (p.Gln211Ter) | CCGTTTTATGTGTCAGYAGCAAA | Premature ovarian failure 4 |
| 121912766 | BMP4 | NM_001202.3(BMP4):c.1037C>T (p.Ala346Val) | CCCCTTTCCACTGGYTGACCACC | Orofacial cleft 11 |
| 199476088 | BMPR1A | NM_004329.2(BMPR1A):c.1127G>A (p.Cys376Tyr) | AGTTRCTGCATTGCTGACCTGGG, GAGTTRCTGCATTGCTGACCTGG | Juvenile polyposis syndrome |
| 764466442 | BMPR1A | NM_004329.2(BMPR1A):c.1081C>T (p.Arg361Ter) | CCCGCAATTGCTCATYGAGACCT, CCGCAATTGCTCATYGAGACCTA | Hereditary cancer-predisposing syndrome |
| 137852744 | BMPR2 | NM_001204.6(BMPR2):c.1040G>A (p.Cys347Tyr) | ACCTRTGTTATTAGTGACTTTGG | Primary pulmonary hypertension |
| 137852746 | BMPR2 | NM_001204.6(BMPR2):c.1471C>T (p.Arg491Trp) | CCAGGATGCAGAGGCTYGGCTTA | Primary pulmonary hypertension |
| 137852751 | BMPR2 | NM_001204.6(BMPR2):c.994C>T (p.Arg332Ter) | CCTGCAATTTCCCATYGAGATTT | Primary pulmonary hypertension |
| 137852756 | BMPR2 | NM_001204.6(BMPR2):c.1297C>T (p.Gln433Ter) | CCGTACCAGAGTACYAGATGGCT | Pulmonary hypertension, primary, 1, with hereditary hemorrhagic telangiectasia |
| 121964925 | BPGM | NM_199186.2(BPGM):c.268C>T (p.Arg90Cys) | CCTGGCGTCTAAATGAGYGTCAC | Deficiency of bisphosphoglycerate mutase |
| 397516894 | BRAF | NM_004333.4(BRAF):c.1720C>T (p.His574Tyr) | CCAAGTCAATCATCYACAGAGAC | Cardiofaciocutaneous syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397509284 | BRCA1 | NM_007294.3(BRCA1):c.5445G>A (p.Trp1815Ter) | GATGCCTGRACAGAGGACAATGG | Familial cancer of breast, Breast-ovarian cancer, familial 1, Hereditary cancer-predisposing syndrome |
| 80356937 | BRCA1 | NM_007294.3(BRCA1):c.5212G>A (p.Gly1738Arg) | GTCAGARGAGATGTGGTCAATGG | Familial cancer of breast, Breast-ovarian cancer, familial 1 |
| 80356962 | BRCA1 | NM_007294.3(BRCA1):c.5444G>A (p.Trp1815Ter) | GATGCCTRGACAGAGGACAATGG | Familial cancer of breast, Hereditary breast and ovarian cancer syndrome, Breast-ovarian cancer, familial 1, Hereditary cancer-predisposing syndrome |
| 80357219 | BRCA1 | NM_007294.3(BRCA1):c.5345G>A (p.Trp1782Ter) | GAATRGATGGTACAGCTGTGTGG | Familial cancer of breast, Breast-ovarian cancer, familial 1 |
| 80357284 | BRCA1 | NM_007294.3(BRCA1):c.5346G>A (p.Trp1782Ter) | GAATGRATGGTACAGCTGTGTGG | Familial cancer of breast, Breast-ovarian cancer, familial 1, Hereditary cancer-predisposing syndrome |
| 80357292 | BRCA1 | NM_007294.3(BRCA1):c.962G>A (p.Trp321Ter) | TAACAGATRGGCTGGAAGTAAGG | Familial cancer of breast, Hereditary breast and ovarian cancer syndrome, Breast-ovarian cancer, familial 1, Hereditary cancer-predisposing syndrome |
| 80358008 | BRCA1 | NM_007294.3(BRCA1):c.4676-1G>A | TTCARAGGGAACCCCTTACCTGG | Breast-ovarian cancer, familial 1 |
| 80358070 | BRCA1 | NM_007294.3(BRCA1):c.4097-1G>A | TTTAARGTGAAGCAGCATCTGGG, ATTTAARGTGAAGCAGCATCTGG | Familial cancer of breast, Breast-ovarian cancer, familial 1 |
| 62625307 | BRCA1 | NM_007294.3(BRCA1):c.3598C>T (p.Gln1200Ter) | CCCATACACATTTGCTYAGGGT, CCATACACATTTGGCTYAGGGTT | Familial cancer of breast, Hereditary breast and ovarian cancer syndrome, Breast-ovarian cancer, familial 1, Hereditary cancer-predisposing syndrome |
| 80356952 | BRCA1 | NM_007294.3(BRCA1):c.1630C>T (p.Gln544Ter) | CCAAACGGAGCAGAATGGTYAAG | Familial cancer of breast, Breast-ovarian cancer, familial 1 |
| 80357089 | BRCA1 | NM_007294.3(BRCA1):c.3331C>T (p.Gln1111Ter) | CCTGAAATAAAAAAGYAAGAATA | Familial cancer of breast, Breast-ovarian cancer, familial 1 |
| 80357123 | BRCA1 | NM_007294.3(BRCA1):c.5251C>T (p.Arg1751Ter) | CCACCAAGTCCAAAGYGAGCAA | Familial cancer of breast, Hereditary breast and ovarian cancer syndrome, Breast-ovarian cancer, familial 1, Hereditary cancer-predisposing syndrome |
| 80357211 | BRCA1 | NM_007294.3(BRCA1):c.949C>T (p.Gln317Ter) | CCTGGCTTAGCAAGGAGCYAACA | Familial cancer of breast, Breast-ovarian cancer, familial 1 |
| 80357372 | BRCA1 | NM_007294.3(BRCA1):c.415C>T (p.Gln139Ter) | CCGTGCCAAAGACTTCTAYAGA, CCAAAAGACTTCTAYAGAGTGAA | Familial cancer of breast, Breast-ovarian cancer, familial 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80357471 | BRCA1 | NM_007294.3(BRCA1):c.178C>T (p.Gln60Ter) | CCAGAAGAAAGGGCCTTCAYAGT | Familial cancer of breast, Breast-ovarian cancer, familial 1 |
| 587781506 | BRCA2 | NM_000059.3(BRCA2):c.7877G>A (p.Trp2626Ter) | TAGATRGATCATATGGAAACTGG | Hereditary breast and ovarian cancer syndrome, Hereditary cancer-predisposing syndrome |
| 80358543 | BRCA2 | NM_000059.3(BRCA2):c.2978G>A (p.Trp993Ter) | AACAAATRGCAGGACTCTTAGG | Breast-ovarian cancer, familial 2 |
| 80358544 | BRCA2 | NM_000059.3(BRCA2):c.2979G>A (p.Trp993Ter) | AACAAATGRGCAGGACTCTTAGG | Familial cancer of breast, Breast-ovarian cancer, familial 2, Hereditary cancer-predisposing syndrome |
| 80359015 | BRCA2 | NM_000059.3(BRCA2):c.7886G>A (p.Trp2629Ter) | CATATRGAAACTGGCAGCTATGG | Familial cancer of breast, Breast-ovarian cancer, familial 2 |
| 80359205 | BRCA2 | NM_000059.3(BRCA2):c.9317G>A (p.Trp3106Ter) | GTTTTRGATAGACCTTAATGAGG | Familial cancer of breast, Breast-ovarian cancer, familial 2 |
| 80359803 | BRCA2 | NM_000059.3(BRCA2):c.8754G>A (p.Glu2918=) | CCTTGARGTGAGAGAGTAAGAGG | Familial cancer of breast, Breast-ovarian cancer, familial 2, Hereditary cancer-predisposing syndrome |
| 730881581 | BRCA2 | NM_000059.3(BRCA2):c.8174G>A (p.Trp2725Ter) | AGATGGGTRGTATGCTGTTAAGG | Familial cancer of breast |
| 276174913 | BRCA2 | NM_000059.3(BRCA2):c.8869C>T (p.Gln2957Ter) | CCATGGAATCTGCTGAAYAAAAG | Familial cancer of breast, Breast-ovarian cancer, familial 2 |
| 80358515 | BRCA2 | NM_000059.3(BRCA2):c.250C>T (p.Gln84Ter) | CCAATAATATTCAAAGAGYAAGG | Familial cancer of breast, Hereditary breast and ovarian cancer syndrome, Breast-ovarian cancer, familial 2 |
| 80358578 | BRCA2 | NM_000059.3(BRCA2):c.3319C>T (p.Gln1107Ter) | CCATAATTTAACACCTAGCYAAA | Familial cancer of breast, Breast-ovarian cancer, familial 2, Hereditary cancer-predisposing syndrome |
| 80358851 | BRCA2 | NM_000059.3(BRCA2):c.6124C>T (p.Gln2042Ter) | CCAGAACATTTAATATCCYAAAA | Hereditary breast and ovarian cancer syndrome, Breast-ovarian cancer, familial 2 |
| 80358920 | BRCA2 | NM_000059.3(BRCA2):c.6952C>T (p.Arg2318Ter) | CCTAGGCACAATAAAAGATYGAA | Familial cancer of breast, Breast-ovarian cancer, familial 2 |
| 587782010 | BRCA2 | NM_000059.3(BRCA2):c.8608C>T (p.Gln2870Ter) | CCTTATTCACTAAAATTYAGGAG | Hereditary cancer-predisposing syndrome |
| 587782613 | BRCA2 | NM_000059.3(BRCA2):c.3412C>T (p.Gln1138Ter) | CCAAGCTACATATTGYAGAAGAG | Hereditary cancer-predisposing syndrome |
| 397507395 | BRCA2 | NM_000059.3(BRCA2):c.7963C>T (p.Gln2655Ter) | CCCGAAAGGGTGCTTCTTYAAC, CCAGAAAGGGTGCTTCTTYAACT | Familial cancer of breast, Breast-ovarian cancer, familial 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397507617 | BRCA2 | NM_000059.3(BRCA2):c.1 96C>T (p.Gln66Ter) | CCTATTTAAAACTCCAYAAAGGA | Familial cancer of breast, Breast-ovarian cancer, familial 2, Hereditary cancer-predisposing syndrome |
| 587782539 | BRIP1 | NM_032043.2(BRIP1):c.25 76-1G>A | TTTCTTTARGACTTTCTAAATGGG, TTTCTTTARGACTTTCTAAATGG | Hereditary cancer-predisposing syndrome |
| 137852985 | BRIP1 | NM_032043.2(BRIP1):c.89 7G>A (p.Met299Ile) | AGTGCATRGAATTGCTAGATGGG, AAGTGCATRGAATTGCTAGATGG | Breast cancer, early-onset |
| 587782574 | BRIP1 | NM_032043.2(BRIP1):c.23 77C>T (p.Gln793Ter) | CCAAATGTGAAAGATCTAYAGGT | Hereditary cancer-predisposing syndrome |
| 730881633 | BRIP1 | NM_032043.2(BRIP1):c.10 66C>T (p.Arg356Ter) | CCATATTACACAGCCYGAGAACT | Hereditary cancer-predisposing syndrome |
| 74315287 | BSND | NM_057176.2(BSND):c.28 G>A (p.Gly10Ser) | GGATCRGCTTCATTGTGCTGGGG, CGGATCRGCTTCATTGTGCTGGG, CCGGATCRGCTTCATTGTGCTGG | Barter syndrome type 4 |
| 74315289 | BSND | NM_057176.2(BSND):c.13 9G>A (p.Gly47Arg) | TGGTCATCRGGGGCATCATCTGG | Barter syndrome type 4 |
| 146015592 | BTD | NM_000060.3(BTD):c.470 G>A (p.Arg157His) | GCTCCAGCRCCCTGAGTTGTATGG | Biotinidase deficiency, not provided |
| 397514396 | BTD | NM_000060.3(BTD):c.934 G>A (p.Gly312Ser) | AAGTRGCATACACCCCCTCTGG | Biotinidase deficiency |
| 397514343 | BTD | NM_000060.3(BTD):c.236 G>A (p.Arg79His) | CATCAGCRCRCCAAGAGGCCTTGG | Biotinidase deficiency |
| 397514375 | BTD | NM_000060.3(BTD):c.595 G>A (p.Val199Met) | AATGTCRTGTTCAGCAATAATGG | Biotinidase deficiency |
| 397514417 | BTD | NM_000060.3(BTD):c.1333 G>A (p.Gly445Arg) | GATRGGCTTCACACAGTACATGG | Biotinidase deficiency |
| 397514428 | BTD | NM_000060.3(BTD):c.1610 G>A (p.Gly537Glu) | CTATGRGCGCTTGTATGAGAGGG, TCTATGRGCGCTTGTATGAGAGG | Biotinidase deficiency |
| 397514429 | BTD | NM_000060.3(BTD):c.1613 G>A (p.Arg538His) | CTATGGGCRCTTGTATGAGAGGG | Biotinidase deficiency |
| 367902696 | BTD | NM_000060.3(BTD):c.443 G>A (p.Arg148His) | TCACCRCTTCAATGACACAGAGG | Biotinidase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 34885143 | BTD | NM_000060.3(BTD):c.133 G>A (p.Gly45Arg) | CCACACCRGGAGGAGAGCGTG G | Biotinidase deficiency, not specified, not provided |
| 146600671 | BTD | NM_000060.3(BTD):c.1369 G>A (p.Val457Met) | TCCAARTGTGTGCCCTGGTCAGG | Biotinidase deficiency |
| 377651057 | BTD | NM_000060.3(BTD):c.935 G>A (p.Gly312Asp) | AAGTGRCATACACACCCCTCTGG | Biotinidase deficiency |
| 104893687 | BTD | NM_000060.3(BTD):c.235 C>T (p.Arg79Cys) | CCCTCTGGCTCTCATCAGCYGCC, CCTCTGGCTCTCATCAGCYGCCA | Biotinidase deficiency, not provided |
| 104893688 | BTD | NM_000060.3(BTD):c.1595 C>T (p.Thr532Met) | CCCTCTGGGCTGGTGAYGGCGGCT | Biotinidase deficiency, not provided |
| 397514349 | BTD | NM_000060.3(BTD):c.283 C>T (p.Gln95Ter) | CCTTGACATCTATGAAYAGCAAG | Biotinidase deficiency |
| 397514363 | BTD | NM_000060.3(BTD):c.469 C>T (p.Arg157Cys) | CCTCTAGGTGCTCCAGYGCCTGA | Biotinidase deficiency |
| 397514364 | BTD | NM_000060.3(BTD):c.485 C>T (p.Ala162Val) | CCTGAGTTGTATGGYCATCAGGG | Biotinidase deficiency |
| 372844636 | BTD | NM_000060.3(BTD):c.631 C>T (p.Arg211Cys) | CCCTTGTTGACCGCTACYGTAAA, CCTTGTTGACCGCTACYGTAAAC | Biotinidase deficiency |
| 128621209 | BTK | NM_000061.2(BTK):c.1838 G>A (p.Gly613Asp) | CCCAAGRCCTACGTCTCTACAGG | X-linked agammaglobulinemia |
| 128621194 | BTK | NM_000061.2(BTK):c.862 C>T (p.Arg288Trp) | CCAAACACATGACTYGGAGTCAG | X-linked agammaglobulinemia |
| 128621204 | BTK | NM_000061.2(BTK):c.1684 C>T (p.Arg562Trp) | CCAAATTTCCAGTCYGGTGTCC | X-linked agammaglobulinemia |
| 128621193 | BTK | NM_000061.2(BTK):c.763 C>T (p.Arg255Ter) | CCATGGTGGAGAGCAYGAGATA A | X-linked agammaglobulinemia |
| 137852956 | C10orf2 | NM_021830.4(C10orf2):c.908G>A (p.Arg303Gln) | GGCRGATTGTATTCTGGTTGGGG, CGGCRGATTGTATTCTGGTTGGG, CCGGCRGATTGTATTCTGGTTGG | Autosomal dominant progressive external ophthalmoplegia with mitochondrial DNA deletions 3 |
| 80356544 | C10orf2 | NM_021830.4(C10orf2):c.1370C>T (p.Thr457Ile) | CCCGGGTCATGCTGAYACAGTTT, CCGGGTCATGCTGAYACAGTTTG | Mitochondrial DNA-depletion syndrome 3, hepatocerebral, Mitochondrial DNA depletion syndrome 7 (hepatocerebral type) |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777698 | C12orf57 | NM_138425.3(C12orf57):c.184C>T (p.Gln62Ter) | CCCGTGGCCACGCAGATCYAGCA, CCGTGGCCACGCAGATCYAGCAG | Temtamy syndrome |
| 397514539 | C12orf65 | NM_152269.4(C12orf65):c.394C>T (p.Arg132Ter) | CCTGTTCACAAAGAAAAYGAG A | Spastic paraplegia 55, autosomal recessive |
| 397514477 | C19orf12 | NM_001031726.3(C19orf12):c.32C>T (p.Thr11Met) | CCCTCGAAGGCCCCGCCAYGATGA CCTCGAAGGCCCGCCAYGATGAC | Neurodegeneration with brain iron accumulation 4 |
| 587777653 | C2CD3 | NM_001286577.1(C2CD3):c.184C>T (p.Arg62Ter) | ACTCRGACAAGTACACAAGTGGG, CACTCRGACAAGTACACAAGTGG | Joubert syndrome, Orofaciodigital syndrome xiv |
| 121909587 | C5 | NM_001735.2(C5):c.55C>T (p.Gln19Ter) | CCTGGGGAAAACCTGGGGAYAG G | Leiner disease |
| 139675596 | C5orf42 | NM_023073.3(C5orf42):c.7477C>T (p.Arg2493Ter) | TCTGGTCRAAAAGTCACATTTGG | Joubert syndrome 17 |
| 121434552 | CA4 | NM_000717.3(CA4):c.206G>A (p.Arg69His) | CTGGGACRCTTCTTCTCTCTGG | Retinitis pigmentosa 17 |
| 104894559 | CA4 | NM_000717.3(CA4):c.40C>T (p.Arg14Trp) | CCTGCCCTCTCCGGGCGYGGC, CCCTCTCCGCGGGCGYGGCCATCG | Retinitis pigmentosa 17 |
| 147623570 | CA5A | NM_001739.1(CA5A):c.555G>A (p.Lys185=) | CCCGAGCAAGTGATTACYTTAA, CCGAGCAAGTGATTACYTTTAAA | Carbonic anhydrase VA deficiency, hyperammonemia due to |
| 121908215 | CACNA1A | NM_001127221.1(CACNA1A):c.877G>A (p.Gly293Arg) | ACTGGGAARGGCCCAACACGG G | Spinocerebellar ataxia 6, Episodic ataxia type 2 |
| 121908216 | CACNA1A | NM_001127221.1(CACNA1A):c.4982G>A (p.Arg1661His) | TCCRCCTCTTCCGAGCTGCCCGG | Episodic ataxia type 2 |
| 121908236 | CACNA1A | NM_001127221.1(CACNA1A):c.860G>A (p.Cys287Tyr) | AATRTCAGCCCTACTGGGAAGGG, AAATRTCAGCCCTACTGGGAAGG, GACCAAATRTCAGCCCTACTGGG | Episodic ataxia type 2 |
| 121908212 | CACNA1A | NM_001127221.1(CACNA1A):c.1997C>T (p.Thr666Met) | CCCCTTTCAGATCCTGAYGGGCG, CCCTTTCAGATCCTGAYGGGCGA, CCTTTCAGATCCTGAYGGGGAA | Familial hemiplegic migraine type 1 |
| 121909323 | CACNA1A | NM_001127221.1(CACNA1A):c.3832C>T (p.Arg1278Ter) | CCCTTACAGTGCTGYGATACTT, CCTTACAGTGCTGYGATACTTT | Episodic ataxia type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909324 | CACNA1A | NM_001127221.1(CACNA 1A):c.4636C>T (p.Arg1546Ter) | CCAAGCCGCTGACCYGACACATG | Episodic ataxia type 2 |
| 587776693 | CACNA1A | NM_001127221.1(CACNA 1A):c.3992+1G>A | CCCTTGCGAGGAGACTTAYGTGA CCTTGCGAGGAGACTTAYGTGAA | Episodic ataxia type 2 |
| 80315385 | CACNA1C | NM_000719.6(CACNA1C): c.1204G>A (p.Gly402Ser) | TGGTTCTCRGTGTGCTTAGCGGG | Timothy syndrome, Congenital long QT syndrome |
| 79891110 | CACNA1C | NM_000719.6(CACNA1C): c.1216G>A (p.Gly406Arg) | TTAGCRGGTAAGCAGGACCAAGG | Timothy syndrome, Long QT syndrome, Congenital long QT syndrome, not provided |
| 587782933 | CACNA1C | NM_001167623.1(CACNA 1C):c.1204G>A (p.Gly402Ser) | TGGTTCTCRGTGTGTTGAGCGGG | Paroxysmal familial ventricular fibrillation, not provided |
| 122456133 | CACNA1F | NM_005183.3(CACNA1F): c.1106G>A (p.Gly369Asp) | TTGRCGTCCTGAGTGGGTGAGGG, CTTGRCGTCCTGAGTGGGTGAGG | Congenital stationary night blindness, type 2A |
| 122456135 | CACNA1F | NM_005183.3(CACNA1F): c.2683C>T (p.Arg895Ter) | CCGCTGAGGACCCCATCYGAGCC | Congenital stationary night blindness, type 2A |
| 80338777 | CACNA1S | NM_000069.2(CACNA1S): c.1583G>A (p.Arg528His) | TCCRCTGCATCCGCCTCCTGAGG | Hypokalemic periodic paralysis 1 |
| 587777742 | CACNB2 | NM_201590.2(CACNB2):c. 32C>T (p.Thr11Ile) | CCTTATAGCTCCTCAAAYTAAAT | Brugada syndrome 4 |
| 121917812 | CACNB2 | NM_201590.2(CACNB2):c. 1442C>T (p.Ser481Leu) | CCGCTCTTCCTCCTYAGCCCCAC | Brugada syndrome 4 |
| 267606699 | CANT1 | NM_001159772.1(CANT1): c.899G>A (p.Arg300His) | CCTGCCGCRCCGCCCAGCCAGG | Desbuquois syndrome |
| 587776951 | CANT1 | NM_001159772.1(CANT1): c.-286+1G>A | CCGCGGGCCAGTCACTCAYCCG | Desbuquois syndrome |
| 377546036 | CANT1 | NM_001159772.1(CANT1): c.676G>A (p.Val226Met) | CCTTGCCCAGGCCGCCAYGTAC | Desbuquois syndrome |
| 141656719 | CAPN3 | NM_000070.2(CAPN3):c.1 468C>T (p.Arg490Trp) | CCTGATGCAGAAGAACCGGYGG A | Limb-girdle muscular dystrophy, type 2A, not provided |
| 121434546 | CAPN3 | NM_000070.2(CAPN3):c.2 57C>T (p.Ser86Phe) | CCCACCGGATGAGAGACCTYTCTCT, CCACCGGATGAGAGACCTYTCTT | Limb-girdle muscular dystrophy, type 2A |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777763 | CARD14 | NM_024110.4(CARD14):c.349+5G>A | GGTGARAGCTCCGACTTTGACGG | Psoriasis susceptibility 2 |
| 398122362 | CARD9 | NM_052813.4(CARD9):c.14G>A (p.Gly72Ser) | GACCRGCCACAAGGGCTACCTGG | Candidiasis, familial, 2 |
| 557671802 | CARS2 | NM_024537.3(CARS2):c.752C>T (p.Pro251Leu) | CCCRGCCTCCGGGTCCCCAGGG, GCCCRGCCTCCGGGTCCCCAGG | Alpers encephalopathy |
| 794727270 | CASK | NM_003688.3(CASK):c.79C>T (p.Arg27Ter) | CCCTTCAGTGTTGTAYGACGATG, CCTTCAGTGTTGTAYGACGATGT | FG syndrome 4, Mental retardation and microcephaly with pontine and cerebellar hypoplasia |
| 587783361 | CASK | NM_003688.3(CASK):c.2074C>T (p.Gln692Ter) | CCATGRGAAGACCAAAYAGGAG | Mental retardation and microcephaly with pontine and cerebellar hypoplasia |
| 587783364 | CASK | NM_003688.3(CASK):c.2470C>T (p.Gln824Ter) | CCGRAGATCCACRAGAGYAGGGGC | Mental retardation and microcephaly with pontine and cerebellar hypoplasia |
| 587783371 | CASK | NM_003688.3(CASK):c.880C>T (p.Gln294Ter) | CCAGAAACAGTAGAGYAGCTGAG | Mental retardation and microcephaly with pontine and cerebellar hypoplasia |
| 28936699 | CASP10 | NM_032977.3(CASP10):c.1241C>T (p.Ala414Val) | CCTTCCGTATCCATCGAAGYAGA, CCGTATCCATCGAAGYAGATGCT | Malignant lymphoma, non-Hodgkin |
| 104893700 | CASR | NM_000388.3(CASR):c.2009G>A (p.Gly670Glu) | TCATGRGRGAGCCCCAGGACTGG | Hyperparathyroidism, neonatal severe |
| 104893712 | CASR | NM_000388.3(CASR):c.1810G>A (p.Glu604Lys) | GATCRAGTTTCTGTCTGTGACGG, AGGAGATCRAGTTTCTGTCTGTGG | Hypocalcemia, autosomal dominant 1 |
| 104893719 | CASR | NM_000388.3(CASR):c.1657G>A (p.Gly553Arg) | CAGGAAARGATCATTGAGGGG, CCAGGAAARGGATCATTGAGGGG | Hypocalciuric hypercalcemia, familial, type 1 |
| 121909264 | CASR | NM_000388.3(CASR):c.428G>A (p.Gly143Glu) | GTGGTGGRAGCAACTGGCTCAGG | Hypocalciuric hypercalcemia, familial, type 1 |
| 121909266 | CASR | NM_000388.3(CASR):c.196C>T (p.Arg66Cys) | CCAGGTATATATTTCYGTGGGTTT | Hypocalciuric hypercalcemia, familial, type 1 |
| 267606708 | CBL | NM_005188.3(CBL):c.1259G>A (p.Arg420Gln) | TTCTGCCRATGTGAAATTAAAGG | Noonan syndrome-like disorder with or without juvenile myelomonocytic leukemia |
| 28934891 | CBS | NM_000071.2(CBS):c.1330G>A (p.Asp444Asn) | CTTCRACCAGGCGCCCGTGTGG, GGGCTCRACCAGGCGCCCCTGG | Homocystinuria due to CBS deficiency, Homocystinuria, pyridoxine-responsive, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908255 | CBX2 | NM_005189.2(CBX2):c.293C>T (p.Pro98Leu) | CCTTTATCTTTCCAGGAACYCGA | 46,XY sex reversal, type 5 |
| 377177061 | CC2D2A | NM_001080522.2(CC2D2A):c.394C>T (p.Arg132Ter) | CCTCGGCCCAGACGCTTAYGAAG | Meckel-Gruber syndrome |
| 201133219 | CCDC114 | NM_144577.3(CCDC114):c.1391+5G>A | CCCTCCTGCCCTGGCGCYTCACAG, CCTCCTGCCCTGGCGCYTCACAGA | Ciliary dyskinesia, primary, 20 |
| 374909386 | CCDC40 | NM_017950.3(CCDC40):c.3354C>A (p.Tyr1118Ter) | CCGCGTGCGGGACGAGTAHCCCC | Ciliary dyskinesia, primary, 15 |
| 387907092 | CCDC40 | NM_017950.3(CCDC40):c.1951C>T (p.Gln651Ter) | CCACCAAATACTTCAACYAGCTC, CCAATATACTTCAACYAGCTCATC | Ciliary dyskinesia, primary, 15 |
| 587782989 | CCDC88C | NM_001080414.3(CCDC88C):c.1391G>A (p.Arg464His) | GTCCAGCCRCATCCTGAAGCTGG | Spinocerebellar ataxia 40 |
| 387907320 | CCDC88C | NM_001080414.3(CCDC88C):c.5058+1G>A | CCATRTGAGTGATCCGGACACGG | Hydrocephalus |
| 137852841 | CCM2 | NM_001029835.2(CCM2):c.382C>T (p.Gln128Ter) | CCGGGACACTTGACTYAGGAGCA | Cerebral cavernous malformations 2 |
| 587777929 | CCT7 | NM_001166284.1(CCT7):c.1313C>T (p.Ser438Leu) | CCATCAAGAACCCCGCTYGACT | Myocardial infarction 1 |
| 74315290 | CD247 | NM_198053.2(CD247):c.208C>T (p.Gln70Ter) | CCAGCAGGGCCAGAACYAGCTCT | Immunodeficiency due to defect in cd3-zeta |
| 730880296 | CD3D | NM_000732.4(CD3D):c.274+5G>A | TACRTGCTTCCTGAACCCTTTGG | Immunodeficiency 19 |
| 193922136 | CD40LG | NM_000074.2(CD40LG):c.761C>T (p.Thr254Met) | CCATGGCACTGGCTTCAYGTCCT | Immunodeficiency with hyper IgM type 1 |
| 587776775 | CD81 | NM_004356.3(CD81):c.561+1G>A | CAAGRTGCGCGAGGCCGGTGGG, TCAAGRTGCGCGAGGCCGGTGGG, TTCAAGRTGCGCGAGGCCGGTGG | |
| 121918660 | CD8A | NM_001768.6(CD8A):c.331G>A (p.Gly111Ser) | CGAGRGCTACTATTTCTGCTCGG | Cd8 deficiency, familial |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 113313967 | CDAN1 | NM_138477.2(CDAN1):c.1 860+5G>A | CCCTTGTTCTGTTTTYGGACCTG, CCTTGTTCTGTTTTYGGACCTGC | Congenital dyserythropoietic anemia, type I |
| 120074167 | CDAN1 | NM_138477.2(CDAN1):c.2 015C>T (p.P672L) | CCCTCCCAGTCCCTCYGGTCCT, CCTCCCAGTCCCCTCYGGTCCTG | Congenital dyserythropoietic anemia, type I |
| 80338696 | CDAN1 | NM_138477.2(CDAN1):c.2 140C>T (p.Arg714Trp) | CCCTTGCTGGAATATTACYGGGA, CCTTGCTGGAATATTACYGGGAC | Congenital dyserythropoietic anemia, type I |
| 80338697 | CDAN1 | NM_138477.2(CDAN1):c.3 124C>T (p.Arg1042Trp) | CCTTGGCCTGGGGCCAYGGGAC | Congenital dyserythropoietic anemia, type I |
| 121434263 | CDC73 | NM_024529.4(CDC73):c.1 28G>A (p.Trp43Ter) | GTTTRGGGTAAGTCCGGCATGG | Parathyroid carcinoma |
| 587776558 | CDC73 | NM_024529.4(CDC73):c.1 31+1G>A | GTTTGGGRTAAGTCCGGCATGG | Hyperparathyroidism 1 |
| 587776559 | CDC73 | NM_024529.4(CDC73):c.2 38-1G>A | TTARACTGAAAATATTCCTGTGG | Hyperparathyroidism 2 |
| 786203576 | CDH1 | NM_004360.3(CDH1):c.60 G>A (p.Trp20Ter) | CTCTTGRCTCTGCCAGGAGCCGG | Hereditary cancer-predisposing syndrome |
| 121964875 | CDH1 | NM_004360.3(CDH1):c.59 G>A (p.Trp20Ter) | CTCTTRGCTCTGCCAGGAGCCGG | Hereditary diffuse gastric cancer |
| 121964877 | CDH1 | NM_004360.3(CDH1):c.17 92C>T (p.Arg598Ter) | CCCCATACCAGAACCTYGAACT, CCCATACCAGAACCTYGAACTA, CCCATACCAGAACCTYGAACTAT, CCATACCAGAACCTYGAACTATA | Hereditary diffuse gastric cancer |
| 587782750 | CDH1 | NM_004360.3(CDH1):c.19 21C>T (p.Gln641Ter) | CCAACTGACCATTYAGTACAAC | Hereditary cancer-predisposing syndrome |
| 121434539 | CDH15 | NM_004933.2(CDH15):c.1 78C>T (p.Arg60Cys) | CCGAGAACCACAAGYGTCTCCCC | Mental retardation, autosomal dominant 3 |
| 397517353 | CDH23 | NM_022124.5(CDH23):c.7 776G>A (p.Trp2592Ter) | CTGRGGCACCACCATGCTCCTGG | Usher syndrome, type 1D |
| 367928692 | CDH23 | NM_022124.5(CDH23):c.6 050-9G>A | GCGGGCACCCRGTGCCAGGTGTGG | Usher syndrome, type 1D |
| 727502931 | CDH23 | NM_022124.5(CDH23):c.7 362+5G>A | GTGARCAGTGATGAGGGCCTGG | Usher syndrome, type 1D |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908354 | CDH23 | NM_022124.5(CDH23):c.7 19C>T (p.Pro240Leu) | CCCATCTTCATCAACCTGCYTTA, CCATCTTCATCAACCTGCYTTAC | Deafness, autosomal recessive 12 |
| 727503845 | CDK16 | NM_033018.3(CDK16):c.1 258C>T (p.Arg420Ter) | CCTTTTGAGCCACGCACCCYGGT | not provided |
| 587783392 | CDK5RAP2 | NM_018249.5(CDK5RAP2):c.5227C>T (p.Gln1743Ter) | CCTGCTCAAACAGATCAGCYAGG | Primary autosomal recessive microcephaly 3 |
| 587783086 | CDKL5 | NM_003159.2(CDKL5):c.5 77G>A (p.Asp193Asn) | TCCGTGRACATGTGCTCGGTGGG, GTCCGTGRACATGTGGTCGGTGG | not provided |
| 267608653 | CDKL5 | NM_003159.2(CDKL5):c.2 152G>A (p.Val718Met) | TACAGARGTAAGCCCACCCCCGG | Early infantile epileptic encephalopathy 2, not provided |
| 122460158 | CDKL5 | NM_003159.2(CDKL5):c.2 500C>T (p.Gln834Ter) | CCTTTCTTTCAGAGCYAGCCATT | Early infantile epileptic encephalopathy 2, Atypical Rett syndrome |
| 61749704 | CDKL5 | NM_003159.2(CDKL5):c.5 39C>T (p.Pro180Leu) | CCAGATGGTATCGTTCGGTCCCYAGAA | Early infantile epileptic encephalopathy 2 |
| 267606713 | CDKL5 | NM_003159.2(CDKL5):c.8 63C>T (p.Thr288Ile) | CCAGCTGACAGATACTTGAYAGA | Early infantile epileptic encephalopathy 2 |
| 587783089 | CDKL5 | NM_003159.2(CDKL5):c.7 00C>T (p.Gln234Ter) | CCACTTCCATCTGAGYAGATGAA | not provided |
| 587783158 | CDKL5 | NM_003159.2(CDKL5):c.2 596C>T (p.Gln866Ter) | CCAGCCCTTAACAGCTCAAYAAA, CCCTTAACAGCTCAAYAAACCAA, CCTTAACAGCTCAAYAAACCAAA | Early infantile epileptic encephalopathy 2, not provided |
| 267608643 | CDKL5 | NM_003159.2(CDKL5):c.1 648C>T (p.Arg550Ter) | CCCTTCTGGAAGAAATAACYGAA, CCTTCTGGAAGAAATAACYGAAA | Early infantile epileptic encephalopathy 2, Atypical Rett syndrome, not provided |
| 267608659 | CDKL5 | NM_003159.2(CDKL5):c.2 413C>T (p.Gln805Ter) | CCCTGATCTTCTGACGTTGYAGA, CCTGATCTTCTGACGTTGYAGAA | Early infantile epileptic encephalopathy 2 |
| 267608663 | CDKL5 | NM_003159.2(CDKL5):c.2 593C>T (p.Gln865Ter) | CCAGCCCTTAACAGCTYAACAAA | Early infantile epileptic encephalopathy 2 |
| 121917832 | CDKN1B | NM_004064.4(CDKN1B):c. 227G>A (p.Trp76Ter) | GAGTRGCAAGAGGTGGAGAAGG, CGAGTRGCAAGAGGTGGAGAAG | Multiple endocrine neoplasia, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907225 | CDKN1C | NM_000076.2(CDKN1C):c.820G>A (p.Asp274Asn) | GATCTCCRGTGAGCCCCGCACGG | Intrauterine growth retardation, metaphyseal dysplasia, adrenal hypoplasia congenita, and genital anomalies |
| 387906918 | CDT1 | NM_030928.3(CDT1):c.196G>A (p.Ala66Thr) | CACCGRCCCGCAGGAGACTGCGG | Meier-Gorlin syndrome 4 |
| 145646425 | CEP164 | NM_014956.4(CEP164):c.1726C>T (p.Arg576Ter) | CCCACCCATGGTAGGYGATCCA, CCCACCCATGGTAGGYGATCCAC, CCACCCATGGTAGGYGATCCACA | Nephronophthisis 15 |
| 387907310 | CEP164 | NM_014956.4(CEP164):c.277C>T (p.Arg93Trp) | CCATGTGACGAACACTATYGGAG | Nephronophthisis 15 |
| 387907311 | CEP164 | NM_014956.4(CEP164):c.1573C>T (p.Gln525Ter) | CCTGCAGCTGTCCCTCYAGAGGT | Nephronophthisis 15 |
| 371812716 | CEP41 | NM_018718.2(CEP41):c.1078C>T (p.Arg360Cys) | GGAGCRGGGTTTGAGTGGCTGG | Joubert syndrome 9/15, digenic |
| 375801610 | CFAP53 | NM_145020.4(CFAP53):c.121C>T (p.Arg41Ter) | TGCGTCRGATTCTTTCTAGATGG | Heterotaxy, visceral, 6, autosomal |
| 398123065 | CFB | NM_001710.5(CFB):c.766C>T (p.Gln256Ter) | CCTGGCACCCAGGGGAAYAACAG | Complement factor B deficiency |
| 104893611 | CFC1 | NM_032545.3(CFC1):c.334C>T (p.Arg112Cys) | CCCGCCCACTTCACCGGCYGCT, CCGGCCCACTTCACCGGCYGCTA, CCCACTTCACCGGCYGCTACTGC | Heterotaxy, visceral, 2, autosomal |
| 121913053 | CFH | NM_000186.3(CFH):c.2876G>A (p.Cys959Tyr) | TACAAATRTTTTGAAGGTTTTGG | Factor H deficiency |
| 121964916 | CFI | NM_000204.3(CFI):c.728G>A (p.Gly243Asp) | TGTGATGRTATCAATGATTGTGG | Afibrinogenemia |
| 132630258 | CFP | NM_002621.2(CFP):c.481C>T (p.Arg161Ter) | CCCGACCCGCAGGYGAGCCTGT | Properdin deficiency, X-linked |
| 672601317 | CFTR | NM_000492.3(CFTR):c.830G>A (p.Trp277Ter) | ATACTGCTRGGAAGAAGCAATGG | Cystic fibrosis |
| 121908753 | CFTR | NM_000492.3(CFTR):c.1055G>A (p.Arg352Gln) | GGTCACTCRGCAATTTCCCTGGG | Cystic fibrosis |
| 121909010 | CFTR | NM_000492.3(CFTR):c.3947G>A (p.Trp1316Ter) | AATATRGAAAGTTGCAGATGAGG | Cystic fibrosis |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397508200 | CFTR | NM_000492.3(CFTR):c.139 3-1G>A | TTTCCARACTTCACTTCTAATGG | Cystic fibrosis |
| 387906369 | CFTR | NM_000492.3(CFTR):c.371 8-1G>A | ACTTATARGTGGGCCTCTTGGG | Cystic fibrosis |
| 397508256 | CFTR | NM_000492.3(CFTR):c.166 G>A (p.Glu56Lys) | CAGARAATGGATAGAGAGCTG G | Cystic fibrosis |
| 397508279 | CFTR | NM_000492.3(CFTR):c.170 G>A (p.Trp57Ter) | CAGAGAATRGATAGAGAGCTG G | Cystic fibrosis |
| 77409459 | CFTR | NM_000492.3(CFTR):c.101 3C>T (p.Thr338Ile) | CCTCCGGAAAATATTCAYCACCA, CCGGAAAATATTCAYCACCATCT | Cystic fibrosis |
| 121908760 | CFTR | NM_000492.3(CFTR):c.212 5C>T (p.Arg709Ter) | CCAATCAACTCTATAYGAAAATT | Cystic fibrosis |
| 121908802 | CFTR | NM_000492.3(CFTR):c.595 C>T (p.His199Tyr) | CCAGGGACTTGCATTGGCAYATT | Cystic fibrosis |
| 121908810 | CFTR | NM_000492.3(CFTR):c.229 0C>T (p.Arg764Ter) | CCCCACGCTTCAGGCAYGAAGGA, CCCACGCTTCAGGCAYGAAGGAG, CCACGCTTCAGGCAYGAAGGAG G | Cystic fibrosis |
| 374946172 | CFTR | NM_000492.3(CFTR):c.235 3C>T (p.Arg785Ter) | CCAAGGTCAGAACATTCACYGAA | Cystic fibrosis |
| 121912816 | CHAT | NM_020549.4(CHAT):c.13 21G>A (p.Glu441Lys) | TGCRAACACTCCCCATTCGATGG | Familial infantile myasthenia |
| 121912819 | CHAT | NM_020549.4(CHAT):c.16 79G>A (p.Arg560His) | TCCATCRCCGATTCCAGGAGGG, GTCCATCRCCGATTCCAGGAGG | Familial infantile myasthenia |
| 794727516 | CHAT | NM_020549.4(CHAT):c.41 8C>T (p.Gln140Ter) | CCCGTGCCCCGCTGYAGCAGAC, CCGTGCCCCGCTGYAGCAGACC | Familial infantile myasthenia |
| 121912821 | CHAT | NM_020549.4(CHAT):c.14 93C>T (p.Ser498Leu) | CCACTTAGCCTCCTYGGCAGAAA | Familial infantile myasthenia |
| 398123000 | CHD2 | NM_001271.3(CHD2):c.13 96C>T (p.Arg466Ter) | CCCTGAAGCAGAGACCAYGATTT, CCTGAAGCAGAGACCAYGATTTG | Epileptic encephalopathy, childhood-onset |
| 727503863 | CHD7 | NM_017780.3(CHD7):c.29 33G>A (p.Trp978Ter) | TAAACTRGCTACTTTTCAATTGG | CHARGE association |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434343 | CHD7 | NM_017780.3(CHD7):c.6322G>A (p.Gly2108Arg) | TAAACACRGGTCAGTCGGACGG | CHARGE association |
| 587783429 | CHD7 | NM_017780.3(CHD7):c.1480C>T (p.Arg494Ter) | CCCAAGCAATCCAGGAAYGAC, CCACAAGCAATCCAGGAAYGACT | CHARGE association |
| 727503861 | CHD7 | NM_017780.3(CHD7):c.1369C>T (p.Gln457Ter) | CCCAGAAACATGCAGYAGTCTC, CCCAGAAACATGCAGYAGTCTCG, CCAGAAACATGCAGYAGTCTCGT | not provided |
| 587783440 | CHD7 | NM_017780.3(CHD7):c.4318C>T (p.Gln1440Ter) | CCTGGATAAAGCTGTCTAYAGT | CHARGE association |
| 587783458 | CHD7 | NM_017780.3(CHD7):c.7957C>T (p.Arg2653Ter) | CCTGTTTGTCAATAAAYGAAATGG | CHARGE association |
| 786203889 | CHEK2 | NM_007194.3(CHEK2):c.278G>A (p.Trp93Ter) | TGCCCCCCTRGGCTCGATTATGGG | Hereditary cancer-predisposing syndrome |
| 587781269 | CHEK2 | NM_007194.3(CHEK2):c.283C>T (p.Arg95Ter) | CCCCTGCCCCCTGGGCTYGATTA, CCCTGCCCCCTGGGCTYGATTAT, CCTGCCCCCTGGGCTYGATTATG | Hereditary cancer-predisposing syndrome |
| 17883862 | CHEK2 | NM_007194.3(CHEK2):c.254C>T (p.Pro85Leu) | CCTGAGGACCAAGAACYTGAGGA | Familial cancer of breast, Hereditary cancer-predisposing syndrome, Osteosarcoma, not specified |
| 637503355 | CHMP2B | NM_014043.3(CHMP2B):c.493C>T (p.Gln165Ter) | CCAAGATATTGTGAATYAAGTTC | Frontotemporal Dementia, Chromosome 3-Linked, not provided |
| 121912796 | CHN1 | NM_001822.5(CHN1):c.682G>A (p.Gly228Ser) | ATGTGGRGTCTCATTGCTCAGGG, TATGTGGRGTCTCATTGCTCAGG | Duane syndrome type 2 |
| 121912798 | CHN1 | NM_001822.5(CHN1):c.937G>A (p.Glu313Lys) | CCTAATTRAAGATGTCAAGATGG | Duane syndrome type 2 |
| 387906599 | CHN1 | NM_001822.5(CHN1):c.422C>T (p.Pro141Leu) | CCAAGATGACGATAAACCYAATT | Duane syndrome type 2 |
| 281865066 | CHRNA4 | NM_000744.6(CHRNA4):c.878C>T (p.Thr293Ile) | CCTGCTGCTCATCAYCGAGATCA | Epilepsy, nocturnal frontal lobe, type 1 |
| 137852810 | CHRNB1 | NM_000747.2(CHRNB1):c.865G>A (p.Val289Met) | TACTRTGTTCCTGCTGCTGTGG | MYASTHENIC SYNDROME, CONGENITAL, 2A, SLOW-CHANNEL |
| 121912672 | CHRNG | NM_005199.4(CHRNG):c.136C>T (p.Arg46Ter) | CCTGCGGCCCGCGGAAYGAGACT | Multiple pterygium syndrome Escobar type |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267606725 | CHRNG | NM_005199.4(CHRNG):c.1 3C>T (p.Gln5Ter) | CCATGCATGGGGCYAGGGCC G | Multiple pterygium syndrome Escobar type |
| 267606734 | CHST3 | NM_004273.4(CHST3):c.1 114G>A (p.Glu372Lys) | GCTACRAGGACGTGCACGCGGG, CGCTACRAGGACGTGCACGCGG | Spondyloepiphyseal dysplasia with congenital joint dislocations |
| 80356700 | CLCN1 | NM_000083.2(CLCN1):c.6 89G>A (p.Gly230Glu) | CGTGGRGAAAGAGGTAGGCCTG G | Myotonia congenita, Congenital myotonia, autosomal dominant form |
| 80356702 | CLCN1 | NM_000083.2(CLCN1):c.9 50G>A (p.Arg317Gln) | TGTTTCRAGTGCTGGCAGTGTGG | Myotonia congenita, Congenital myotonia, autosomal recessive form, Congenital myotonia, autosomal dominant form |
| 80356693 | CLCN1 | NM_000083.2(CLCN1):c.1 412C>T (p.Ser471Phe) | CCAGTTCTGGATGTYCATCGTGG | Myotonia congenita |
| 80356706 | CLCN1 | NM_000083.2(CLCN1):c.2 795C>T (p.Pro932Leu) | CCCCAGAGACCCCTGTGCYATCT, CCCAGAGACCCCTGTGCYATCTC, CCAGAGACCCCTGTGCYATCTCC | Myotonia congenita, Congenital myotonia, autosomal recessive form |
| 80356694 | CLCN1 | NM_000083.2(CLCN1):c.1 439C>T (p.Pro480Leu) | CCACCACTATGCCCATACYCTGC, CCACTATGCCCATACYCTGCGGA | Myotonia congenita, Congenital myotonia, autosomal dominant form |
| 201330912 | CLCN2 | NM_004366.5(CLCN2):c.1 709G>A (p.Trp570Ter) | CCGTACTGTGGCGCCCCYAGCC | Leukoencephalopathy with ataxia |
| 151340625 | CLCN5 | NM_001127899.3(CLCN5): c.1727G>A (p.Gly576Glu) | GTTGRGGCTGCAGCCTGCTTAGG | |
| 121434433 | CLCN7 | NM_001287.5(CLCN7):c.2 285G>A (p.Arg762Gln) | TGTTCCRGGCCCTGGGCCTGCGG | Osteopetrosis autosomal recessive 4 |
| 121434432 | CLCN7 | NM_001287.5(CLCN7):c.1 663C>T (p.Gln555Ter) | CCTGATGGGAGCTGCTGCCYAGC | Osteopetrosis autosomal recessive 4 |
| 121434435 | CLCN7 | NM_001287.5(CLCN7):c.2 299C>T (p.Arg767Trp) | CCGGGCCCTCGGGCCTGYGGCACC | Osteopetrosis autosomal dominant type 2, Osteopetrosis autosomal recessive 4 |
| 121909132 | CLCNKB | NM_000085.4(CLCNKB):c. 610G>A (p.Ala204Thr) | GGCARCGGCGCAGTGGGCGTG G | Bartter syndrome type 3 |
| 121909136 | CLCNKB | NM_000085.4(CLCNKB):c. 1830G>A (p.Trp610Ter) | CTGRCTCCTGGACACCAGTGG, TTCCTGRCTCCTGGACACCAGG | Bartter syndrome, type 3, with hypocalciuria |
| 121909131 | CLCNKB | NM_000085.4(CLCNKB):c. 371C>T (p.Pro124Leu) | CCAAGGTTCTGGAATCCYGAGG | Bartter syndrome type 3 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893721 | CLDN16 | NM_006580.3(CLDN16):c. 715G>A (p.Gly239Arg) | CTCRGAATGGCTGGGTCTCTGGG, GCTCRGAATGGCTGGGTCTCTGG | Primary hypomagnesemia |
| 104893723 | CLDN16 | NM_006580.3(CLDN16):c. 593G>A (p.Gly198Asp) | TCAGRTACCCAGGAATCATTGG | Primary hypomagnesemia |
| 104893727 | CLDN16 | NM_006580.3(CLDN16):c. 698G>A (p.Gly233Asp) | TTTGRTTGGTCCTGTTGGCTCGG | Primary hypomagnesemia |
| 796052335 | CLN3 | NM_001042432.1(CLN3):c. 949C>T (p.Gln317Ter) | CCCTGAGTCACGCTYAGCAATAC | not provided |
| 104894484 | CLN6 | NM_017882.2(CLN6):c.368 G>A (p.Gly123Asp) | CATGGRTGCCAGCATCCACCTGG | Ceroid lipofuscinosis neuronal 6 |
| 796052356 | CLN6 | NM_017882.2(CLN6):c.665 +1G>A | CTGRTGAGTGGACATCAGCATGG | not provided |
| 154774635 | CLN6 | NM_017882.2(CLN6):c.139 C>T (p.Leu47Phe) | CCCTTCCACCTCGACYTCTGGTT, CCTTCCACCTCGACYTCTGTTC | Adult neuronal ceroid lipofuscinosis, not provided |
| 104893615 | CNGA3 | NM_001298.2(CNGA3):c.1 669G>A (p.Gly557Arg) | ACATCAAGRGGAGCAAGTCGGG | Achromatopsia 2, not specified |
| 104893619 | CNGA3 | NM_001298.2(CNGA3):c.1 585G>A (p.Val529Met) | GGCCRTGGTGGCTGATGATGGGG, TGGCCRTGGTGGCTGATGATGGG, CTGGCCRTGGTGGCTGATGATGG | Achromatopsia 2 |
| 104893613 | CNGA3 | NM_001298.2(CNGA3):c.8 47C>T (p.Arg283Trp) | CCGCCTACTGAAGTTTTCCYGGC, CCTACTGAAGTTTTCCYGGCTCT | Achromatopsia 2 |
| 104893620 | CNGA3 | NM_001298.2(CNGA3):c.8 29C>T (p.Arg277Cys) | CCCAGAAGTGAGGTTCAACYGCC, CCAGAAGTGAGGTTCAACYGCCT | Achromatopsia 2 |
| 104893621 | CNGA3 | NM_001298.2(CNGA3):c.1 306C>T (p.Arg436Trp) | CCAAGGACTTGGAGAGCGYGGGTT | Achromatopsia 2 |
| 372504780 | CNGB1 | NM_001297.4(CNGB1):c.9 52C>T (p.Gln318Ter) | TCCTRGTGGGCATCCTCCAGGG, ATCCTRGTGGGCATCCTCCCAGG | Retinitis pigmentosa 45, not provided |
| 786205909 | CNNM2 | NM_017649.4(CNNM2):c.3 64G>A (p.Glu122Lys) | CCTTCACCRAGCACGAGCGCGG | HYPOMAGNESEMIA, SEIZURES, AND MENTAL RETARDATION |
| 786205910 | CNNM2 | NM_017649.4(CNNM2):c.1 069G>A (p.Glu357Lys) | CTTCGGARAGATCGTGCCCCAGG | HYPOMAGNESEMIA, SEIZURES, AND MENTAL RETARDATION |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80100937 | CNNM4 | NM_020184.3(CNNM4):c.1690C>T (p.Gln564Ter) | CCTCCTACAGAGGTCTCTYAGTT, CCTACAGAGGTCTCTYAGTTTAG | Cone-rod dystrophy amelogenesis imperfecta |
| 398124268 | CNTNAP2 | NM_014141.5(CNTNAP2): c.2153G>A (p.Trp718Ter) | TACTRGGGAGGCTCTGGGCCTGG | not provided |
| 587777136 | COASY | NM_025233.6(COASY):c.175C>T (p.Gln59Ter) | CCCCAGTCCAGCCCCGTGYAGGC, CCAGTCCAGCCCCGTGYAGGCC, CCAGTCCAGCCCCGTGYAGGCCA | Neurodegeneration with brain iron accumulation 6 |
| 267606740 | COG4 | NM_015386.2(COG4):c.2197C>T (p.Arg733Trp) | CCGAGACAAGTTTGCCYGGCTCT | Congenital disorder of glycosylation type 2J |
| 121912946 | COL11A2 | NM_080680.2(COL11A2):c.4322G>A (p.Gly1441Glu) | CCCTGRGCAGAAGGGTGAGATGG | Weissenbacher-Zweymuller syndrome |
| 121912947 | COL11A2 | NM_080680.2(COL11A2):c.3100C>T (p.Arg1034Cys) | CCCATTGGTCCGCCAGGGYGCCC, CCATTGGTCCGCCAGGGYGCCCA | Deafness, autosomal dominant 13 |
| 121912951 | COL11A2 | NM_080680.2(COL11A2):c.3991C>T (p.Arg1331Ter) | CCTGGTTCCGAGGGYGACAAGG | |
| 200487396 | COL12A1 | NM_004370.5(COL12A1):c.5893C>T (p.Arg1965Cys) | ACAACGCRATATTGCAGCACAGG | BETHLEM MYOPATHY 2 |
| 796052094 | COL12A1 | NM_004370.5(COL12A1):c.8357G>A (p.Gly2786Asp) | CCAGRCCCCAGGGTCCTCCAGG | BETHLEM MYOPATHY 2 |
| 121912773 | COL17A1 | NM_000494.3(COL17A1):c.1898G>A (p.Gly633Asp) | CGTGRTGAGGCAGGGCCTCCTGG | Adult junctional epidermolysis bullosa |
| 121912769 | COL17A1 | NM_000494.3(COL17A1):c.3676C>T (p.Arg1226Ter) | CCTGGTCCCCCAGGGCCTYGAGG | Adult junctional epidermolysis bullosa, Epidermolysis bullosa, junctional, localisata variant |
| 72648320 | COL1A1 | NM_000088.3(COL1A1):c.1200+1G>A | GCCAATRTAAGTATCCTGCCAGG | Osteogenesis imperfecta |
| 72648356 | COL1A1 | NM_000088.3(COL1A1):c.1598G>A (p.Gly533Asp) | AGCTGRTCTGCCTGGTGCCAAGG | Osteogenesis imperfecta, recessive perinatal lethal |
| 72651646 | COL1A1 | NM_000088.3(COL1A1):c.2156G>A (p.Gly719Asp) | CCCGRTAGCCAGGGCGCCCCTGG | Osteogenesis imperfecta, recessive perinatal lethal |
| 72651651 | COL1A1 | NM_000088.3(COL1A1):c.2210G>A (p.Gly737Asp) | GCTGRTCTTCCAGGGCCTAAGG, AGCTGRTCTTCCAGGGCCTAAGG | Osteogenesis imperfecta, recessive perinatal lethal |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72653131 | COL1A1 | NM_000088.3(COL1A1):c.2515G>A (p.Gly839Ser) | GCTRGTCCCCTGGCCCTGCCGG | Osteogenesis imperfecta type III |
| 72653136 | COL1A1 | NM_000088.3(COL1A1):c.2533G>A (p.Gly845Arg) | GCCRGACCCGCTGGACCCCCTGG | Osteogenesis imperfecta, recessive perinatal lethal |
| 72653137 | COL1A1 | NM_000088.3(COL1A1):c.2552G>A (p.Gly851Asp) | CCCCCTGRCCCCATTGTGAGTGG | Osteogenesis imperfecta, recessive perinatal lethal |
| 72653169 | COL1A1 | NM_000088.3(COL1A1):c.3028G>A (p.Gly1010Ser) | CCCTRGTGAATCTGGACGTGAGG | Osteogenesis imperfecta with normal sclerae, dominant form |
| 72653172 | COL1A1 | NM_000088.3(COL1A1):c.3073G>A (p.Gly1025Arg) | CCTRGACGAGACGGTTCTCCTGG | Osteogenesis imperfecta, recessive perinatal lethal |
| 72653178 | COL1A1 | NM_000088.3(COL1A1):c.3118G>A (p.Gly1040Ser) | ACCRGCCCCGCTGGACCCCCTGG | Osteogenesis imperfecta type III |
| 72654797 | COL1A1 | NM_000088.3(COL1A1):c.3182G>A (p.Gly1061Asp) | GCTGRCAAGAGTGGTGATCGTGG | Osteogenesis imperfecta, recessive perinatal lethal |
| 72654802 | COL1A1 | NM_000088.3(COL1A1):c.3235G>A (p.Gly1079Ser) | GTCRGCCCTGTTGGCGCCCGTGG | Osteogenesis imperfecta type I |
| 72656306 | COL1A1 | NM_000088.3(COL1A1):c.3271G>A (p.Gly1091Ser) | CAARGCCCCGTGGTGACAAGGG, CCAARGCCCCGTGGTGACAAGG | Osteogenesis imperfecta, recessive perinatal lethal |
| 72656330 | COL1A1 | NM_000088.3(COL1A1):c.3541G>A (p.Gly1181Ser) | CCCRGCCCTCCTGGACCTCCTGG | Osteogenesis imperfecta, recessive perinatal lethal |
| 66523073 | COL1A1 | NM_000088.3(COL1A1):c.3064G>A (p.Gly1022Ser) | GAARGTTCCCCTGGACGAGACGG | Osteogenesis imperfecta type III |
| 72645320 | COL1A1 | NM_000088.3(COL1A1):c.761G>A (p.Gly254Glu) | CGAGRATTGCCCGGAACAGCTGG | Osteogenesis imperfecta type III |
| 72645333 | COL1A1 | NM_000088.3(COL1A1):c.824G>A (p.Gly275Asp) | GATGRTGCCAAGGGAGATGCTGG | Osteogenesis imperfecta, recessive perinatal lethal |
| 72645357 | COL1A1 | NM_000088.3(COL1A1):c.994G>A (p.Gly332Arg) | TGCCRGGCCCCCTGTGAGTGTGG | Osteogenesis imperfecta, Osteogenesis imperfecta type III |
| 72653170 | COL1A1 | NM_000088.3(COL1A1):c.3040C>T (p.Arg1014Cys) | CCCCCTGGTGAATCTGGAYGTGA, CCCTGGTGAATCTGGAYGTGAG, CCCTGGTGAATCTGGAYGTGAGG, CCTGGTGAATCTGGAYGTGAGGT | Infantile cortical hyperostosis |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72653173 | COL1A1 | NM_000088.3(COL1A1):c.3076C>T (p.Arg1026Ter) | CCGAAGGTTCCCCTGGAYGAGAC | Osteogenesis imperfecta |
| 72645347 | COL1A1 | NM_000088.3(COL1A1):c.934C>T (p.Arg312Cys) | CCTGCCTGGTGAGAGAGGTYGCC, CCTGGTGAGAGAGGTYGCCCTGG | Ehlers-Danlos syndrome, classic type |
| 72658152 | COL1A2 | NM_000089.3(COL1A2):c.1981G>A (p.Gly661Ser) | CCTRGTCTCAGAGGTGAAATTGG | Osteoporosis |
| 72658161 | COL1A2 | NM_000089.3(COL1A2):c.2099G>A (p.Gly700Asp) | GCTRGTCCTGCTGGTCCTGCTGG | Osteogenesis imperfecta type III, Osteogenesis imperfecta with normal sclerae, dominant form |
| 72658176 | COL1A2 | NM_000089.3(COL1A2):c.2251G>A (p.Gly751Ser) | AACRGTGTTGTTGGTCCCACAGG | Osteogenesis imperfecta type III |
| 72658200 | COL1A2 | NM_000089.3(COL1A2):c.2575G>A (p.Gly859Ser) | CCTRGCACTCCAGGTCCTCAGGG, TCCTRGCACTCCAGGTCCTCAGG | Osteogenesis imperfecta type III |
| 72659338 | COL1A2 | NM_000089.3(COL1A2):c.3295G>A (p.Gly1099Arg) | CCTRGACCTCCAGGTGTAAGCGG | Osteogenesis imperfecta type III |
| 121912900 | COL1A2 | NM_000089.3(COL1A2):c.2720G>A (p.Gly907Asp) | CGTGRTCCTCCTGGTGCTGTGGG, CCGTGRTCCTCCTGGTGCTGTGG | Osteogenesis imperfecta, recessive perinatal lethal |
| 121912901 | COL1A2 | NM_000089.3(COL1A2):c.1640G>A (p.Gly547Asp) | CAGGRTCCCCCTGGTCCTCCAGG | Osteogenesis imperfecta, recessive perinatal lethal |
| 121912902 | COL1A2 | NM_000089.3(COL1A2):c.2593G>A (p.Gly865Ser) | CAGRGTCTTCTTGGTGCTCCTGG | Osteogenesis imperfecta, recessive perinatal lethal |
| 121912904 | COL1A2 | NM_000089.3(COL1A2):c.2414G>A (p.Gly805Asp) | TCTGRCCCTCCTGGTCCCCCTGG | Osteogenesis imperfecta, recessive perinatal lethal |
| 121912909 | COL1A2 | NM_000089.3(COL1A2):c.1739G>A (p.Gly580Asp) | TTTGRTCTCCCCTGGTCCTGCTGG | Osteogenesis imperfecta, recessive perinatal lethal |
| 121912910 | COL1A2 | NM_000089.3(COL1A2):c.1504G>A (p.Gly502Ser) | TAGRGTGATCCTGGCAAAAACGG | Osteogenesis imperfecta, recessive perinatal lethal |
| 267606741 | COL1A2 | NM_000089.3(COL1A2):c.1262G>A (p.Gly421Asp) | CCTGRTAGTCGTGGTGCAAGTGG | Osteogenesis imperfecta, recessive perinatal lethal |
| 267606742 | COL1A2 | NM_000089.3(COL1A2):c.3269G>A (p.Gly1090Asp) | CAGGRCCCCCCTGGTCCCCCTGG | Osteogenesis imperfecta type III |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72656387 | COL1A2 | NM_000089.3(COL1A2):c.838G>A (p.Gly280Ser) | GCCRGTCCCGTGGTGAAGTGGG, CGCCRGTCCCGTGTGAAGTGG | Osteogenesis imperfecta |
| 121912864 | COL2A1 | NM_001844.4(COL2A1):c.3220G>A (p.Gly1074Ser) | CCTRGCTCCCCTGGCCCCGTGG | Hypochondrogenesis |
| 121912867 | COL2A1 | NM_001844.4(COL2A1):c.2320G>A (p.Gly774Ser) | AAARGCCCTCGAGGGAGCCCCTGG | Hypochondrogenesis |
| 121912872 | COL2A1 | NM_001844.4(COL2A1):c.800G>A (p.Gly267Asp) | AAGGGRTCCGCCTGGTCCTCAGG | STICKLER SYNDROME, TYPE I, NONSYNDROMIC OCULAR |
| 121912877 | COL2A1 | NM_001844.4(COL2A1):c.908G>A (p.Gly303Asp) | GGCGGRTGCTCCTGGTGTGAAGG | Stickler syndrome type 1, Kniest dysplasia |
| 121912878 | COL2A1 | NM_001844.4(COL2A1):c.2905G>A (p.Gly969Ser) | GAARGTCCACCAGGTCCCCAGGG, CGAARGTCCACCAGGTCCCCAGG | Achondrogenesis type 2 |
| 121912888 | COL2A1 | NM_001844.4(COL2A1):c.1547G>A (p.Gly516Asp) | CGCGRTTTCCCAGGTCAAGATGG | Achondrogenesis type 2 |
| 121912891 | COL2A1 | NM_001844.4(COL2A1):c.3508G>A (p.Gly1170Ser) | GTCRGTCCCTCTGGCAAAGATGG | Coxa plana |
| 121912894 | COL2A1 | NM_001844.4(COL2A1):c.952G>A (p.Gly318Arg) | GAACRGATCTCCGGGCCCAATGG | Rhegmatogenous retinal detachment, autosomal dominant |
| 121912896 | COL2A1 | NM_001844.4(COL2A1):c.141G>A (p.Trp47Ter) | TGTGRAAGCCGGAGCCCTGCCGG | STICKLER SYNDROME, TYPE I, NONSYNDROMIC OCULAR |
| 138498898 | COL2A1 | NM_001844.4(COL2A1):c.4148C>T (p.Thr1383Met) | CTTCCRTGGACAGCAGGCGTAGG | |
| 121912868 | COL2A1 | NM_001844.4(COL2A1):c.3158G>A (p.Gly1053Glu) | CTGRAGTCAAGGTGAGTGTCTGG | Hypochondrogenesis |
| 387906558 | COL2A1 | NM_001844.4(COL2A1):c.2149G>A (p.Gly717Ser) | CAGRGTCCCCGTGGCCTCCCCGG | |
| 121912865 | COL2A1 | NM_001844.4(COL2A1):c.2155C>T (p.Arg719Cys) | CCAGGGRCCTCCAGGGTCCCYGTG | Osteoarthritis with mild chondrodysplasia |
| 121912882 | COL2A1 | NM_001844.4(COL2A1):c.2710C>T (p.Arg904Cys) | CCCTGGAGCTGCTGGCYGCGTTG, CCTGGAGCTGCTGGCYGCGTTGG | Epiphyseal dysplasia, multiple, with myopia and conductive deafness |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 113871730 | COL3A1 | NM_000090.3(COL3A1):c.926G>A (p.Gly309Glu) | GAGRACGGCCAGGACTTCCTGGG, CGAGRACGGCCAGGACTTCCTGG | Ehlers-Danlos syndrome, type 4 |
| 113485686 | COL3A1 | NM_000090.3(COL3A1):c.2356G>A (p.Gly786Arg) | CCCRGACTTCCAGGTATAGCTGG | Ehlers-Danlos syndrome, type 4, Ehlers-Danlos syndrome, type 4 variant |
| 121912916 | COL3A1 | NM_000090.3(COL3A1):c.3041G>A (p.Gly1014Glu) | CAGGRAAACCCTGGATCAGATGG | Ehlers-Danlos syndrome, type 4 |
| 121912919 | COL3A1 | NM_000090.3(COL3A1):c.907G>A (p.Gly303Arg) | AGARGGGCTTCCTGGTGAGCGAGG | Ehlers-Danlos syndrome, type 4 |
| 121912920 | COL3A1 | NM_000090.3(COL3A1):c.2410G>A (p.Gly804Ser) | ACTRGCCCTCCAGGACCTGCTGG | |
| 121912921 | COL3A1 | NM_000090.3(COL3A1):c.1997G>A (p.Gly666Asp) | GCCGRTGCACTTGGAGCTCCAGG | Ehlers-Danlos syndrome, type 4 |
| 121912924 | COL3A1 | NM_000090.3(COL3A1):c.3302G>A (p.Gly1101Glu) | CGTGRAGCTGCTGGCATCAAAGG | Ehlers-Danlos syndrome, type 4 |
| 587779419 | COL3A1 | NM_000090.3(COL3A1):c.1033G>A (p.Gly345Arg) | CCCTRGATCCCCTGGTGCTAAGG | Ehlers-Danlos syndrome, type 4 |
| 587779432 | COL3A1 | NM_000090.3(COL3A1):c.2780G>A (p.Gly927Asp) | GCTGRCCAACCAGGAGAGAAGG, TGCTGRCCAACCAGGAGAGAAG G | Ehlers-Danlos syndrome, type 4 |
| 587779434 | COL3A1 | NM_000090.3(COL3A1):c.2861G>A (p.Gly954Glu) | ACTGRAGCACGGGGTCTTGCAGG | Ehlers-Danlos syndrome, type 4 |
| 587779437 | COL3A1 | NM_000090.3(COL3A1):c.2140G>A (p.Gly714Arg) | CCTRGGCCACCTGGTGCTGCTGG | Ehlers-Danlos syndrome, type 4 |
| 587779438 | COL3A1 | NM_000090.3(COL3A1):c.2824G>A (p.Gly942Arg) | TAGRGAGCTCCAGGCCCACTTGG | Ehlers-Danlos syndrome, type 4 |
| 587779439 | COL3A1 | NM_000090.3(COL3A1):c.3301G>A (p.Gly1101Arg) | CGTRGAGCTGCTGGCATCAAAGG | Ehlers-Danlos syndrome, type 4 |
| 587779446 | COL3A1 | NM_000090.3(COL3A1):c.556G>A (p.Gly186Ser) | CCTRGTACATCTGGTCATCCTGG | Ehlers-Danlos syndrome, type 4 |
| 587779447 | COL3A1 | NM_000090.3(COL3A1):c.2842G>A (p.Gly948Arg) | CTTRGGATTGCTGGGATCACTGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779456 | COL3A1 | NM_000090.3(COL3A1):c. 2978G>A (p.Gly993Asp) | CGTGRTCCCCTGGACCCCAGGG, ACGTGRTCCCCTGGACCCCAGG | Ehlers-Danlos syndrome, type 4 |
| 587779466 | COL3A1 | NM_000090.3(COL3A1):c. 2564G>A (p.Gly855Asp) | CCTGRTCCCAAGGTGTCAAAGG | Ehlers-Danlos syndrome, type 4 |
| 587779472 | COL3A1 | NM_000090.3(COL3A1):c. 3473G>A (p.Gly1158Asp) | CAGRTCCCATTGGACCACCAGGG, CCAGRTCCCATTGGACCACCAGG | Ehlers-Danlos syndrome, type 4 |
| 587779474 | COL3A1 | NM_000090.3(COL3A1):c. 2068G>A (p.Gly690Arg) | GCARGGGCCCCAGGACTTAGAGG | Ehlers-Danlos syndrome, type 4 |
| 587779476 | COL3A1 | NM_000090.3(COL3A1):c. 1466G>A (p.Gly489Glu) | CCTGRGTTCCGAGGACCTGCTGG | Ehlers-Danlos syndrome, type 4 |
| 587779478 | COL3A1 | NM_000090.3(COL3A1):c. 809G>A (p.Gly27Glu) | GATGRACGAAATGGAGAAAAGG, CGATGRACGAAATGGAGAAAAG G | Ehlers-Danlos syndrome, type 4 |
| 587779482 | COL3A1 | NM_000090.3(COL3A1):c. 3508G>A (p.Gly1170Ser) | CAGARGTGAAAGAGATCTGAG G | Ehlers-Danlos syndrome, type 4 |
| 587779484 | COL3A1 | NM_000090.3(COL3A1):c. 2203G>A (p.Gly735Arg) | CTTRGAAGTCCTGGTCCAAAGGG, TCTTRGAAGTCCTGGTCCAAAGG | Ehlers-Danlos syndrome, type 4 |
| 587779493 | COL3A1 | NM_000090.3(COL3A1):c. 1979G>A (p.Gly660Asp) | CAGRTCCAAAGGGTGATGCCGG | Ehlers-Danlos syndrome, type 4 |
| 587779494 | COL3A1 | NM_000090.3(COL3A1):c. 2555G>A (p.Gly852Asp) | TAGGRTCCTCCTGGTCCCCAAGG | Ehlers-Danlos syndrome, type 4 |
| 587779495 | COL3A1 | NM_000090.3(COL3A1):c. 3437G>A (p.Gly1146Glu) | AGTGRACCTCCTGGCAAAGATGG | Ehlers-Danlos syndrome, type 4 |
| 587779499 | COL3A1 | NM_000090.3(COL3A1):c. 1087G>A (p.Gly363Ser) | AATRGTGCCCCTGGACAAAGAGG | Ehlers-Danlos syndrome, type 4 |
| 587779501 | COL3A1 | NM_000090.3(COL3A1):c. 3255+5G>A (p.Gly1068_Pro1085del) | CTGTAARTTTTGTCATTTTTGG | Ehlers-Danlos syndrome, type 4 |
| 587779504 | COL3A1 | NM_000090.3(COL3A1):c. 3562G>A (p.Gly1188Arg) | CCTRGACCTCCTGGTGCCCTGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779505 | COL3A1 | NM_000090.3(COL3A1):c. 2708G>A (p.Gly903Glu) | GATGRGCCCCAGGTCCTGCGGG, GGATGRGCCCCAGGTCCTGCGG | Ehlers-Danlos syndrome, type 4 |
| 587779511 | COL3A1 | NM_000090.3(COL3A1):c. 2888G>A (p.Gly963Asp) | CCAGRCATGCCAGGTCCTAGGGG, ACCAGRCATGCCAGGTCCTAGGG, CACCAGRCATGCCAGGTCCTAGG | Ehlers-Danlos syndrome, type 4 |
| 587779517 | COL3A1 | NM_000090.3(COL3A1):c. 2825G>A (p.Gly942Glu) | AGGRAGCTCCAGGCCCACTTGGG, TAGGRAGCTCCAGGCCCACTTGG | Ehlers-Danlos syndrome, type 4 |
| 587779526 | COL3A1 | NM_000090.3(COL3A1):c. 2510G>A (p.Gly837Asp) | GGAGRCCCTCCTGGAGTTGCAGG | Ehlers-Danlos syndrome, type 4 |
| 587779536 | COL3A1 | NM_000090.3(COL3A1):c. 3391G>A (p.Gly1131Ser) | ATCRGCAGTCCAGGACCTGCAGG | Ehlers-Danlos syndrome, type 4 |
| 587779538 | COL3A1 | NM_000090.3(COL3A1):c. 1149+5G>A (p.Gly351_Pro383del) | TGTAARTATCATAGTTGAGAGGG, CTGTAARTATCATAGTTGAGAGG | Ehlers-Danlos syndrome, type 4 |
| 587779540 | COL3A1 | NM_000090.3(COL3A1):c. 3167G>A (p.Gly1056Asp) | GTCGRTCCAGCTGGAAAGAGTGG | Ehlers-Danlos syndrome, type 4 |
| 587779543 | COL3A1 | NM_000090.3(COL3A1):c. 2185G>A (p.Gly729Arg) | CCTRGAAAGAGAGGAGGTCTTGG | Ehlers-Danlos syndrome, type 4 |
| 587779545 | COL3A1 | NM_000090.3(COL3A1):c. 3140G>A (p.Gly1047Asp) | CCTGRTCATCCAGGCCCACCTGG | Ehlers-Danlos syndrome, type 4 |
| 587779549 | COL3A1 | NM_000090.3(COL3A1):c. 2150G>A (p.Gly717Asp) | CCTGRTGCTGCTGGTACTCCTGG | Ehlers-Danlos syndrome, type 4 |
| 587779554 | COL3A1 | NM_000090.3(COL3A1):c. 3220G>A (p.Gly1074Ser) | GCTRGTGCTCCCGGTCCTCTGCTGG | Ehlers-Danlos syndrome, type 4 |
| 587779557 | COL3A1 | NM_000090.3(COL3A1):c. 637G>A (p.Gly213Ser) | CAGRCCCTCCAGGACCTCCTGG | Ehlers-Danlos syndrome, type 4 |
| 587779561 | COL3A1 | NM_000090.3(COL3A1):c. 3319G>A (p.Gly1107Arg) | AAARGACATCGAGGATTCCCTGG | Ehlers-Danlos syndrome, type 4 |
| 587779567 | COL3A1 | NM_000090.3(COL3A1):c. 2833G>A (p.Gly945Ser) | CCARGCCCACTTGGGATTGCTGG | Ehlers-Danlos syndrome, type 4 |
| 587779569 | COL3A1 | NM_000090.3(COL3A1):c. 1124G>A (p.Gly375Glu) | CAGGRACACGCTGGTGCTCAAGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779576 | COL3A1 | NM_000090.3(COL3A1):c. 2987G>A (p.Gly996Glu) | CCTGRACCCCAGGGTCTTCCTGG | Ehlers-Danlos syndrome, type 4 |
| 587779580 | COL3A1 | NM_000090.3(COL3A1):c. 2905G>A (p.Gly969Arg) | AGGRGAAGCCCTGGCCTCAGGG, TAGGRGAAGCCCTGGCCCTCAGG | Ehlers-Danlos syndrome, type 4 |
| 587779581 | COL3A1 | NM_000090.3(COL3A1):c. 2168G>A (p.Gly723Asp) | CCTGRTCTGCAAGGAATGCCTGG | Ehlers-Danlos syndrome, type 4 |
| 587779583 | COL3A1 | NM_000090.3(COL3A1):c. 2959G>A (p.Gly987Ser) | AACRGTCTCAGTGAGAGAACGTGG | Thoracic aortic aneurysms and aortic dissections, Ehlers-Danlos syndrome, type 4 |
| 587779584 | COL3A1 | NM_000090.3(COL3A1):c. 1618G>A (p.Gly540Arg) | CCCRGAAGTCCAGGAGGACCAGG | Thoracic aortic aneurysms and aortic dissections, Ehlers-Danlos syndrome, type 4 |
| 587779586 | COL3A1 | NM_000090.3(COL3A1):c. 1268G>A (p.Gly423Asp) | AATGRTGCTCCTGGACTGCGAGG | Ehlers-Danlos syndrome, type 4 |
| 587779591 | COL3A1 | NM_000090.3(COL3A1):c. 2087G>A (p.Gly696Asp) | AGAGRTGGAGCTGGTCCCCCTGG | Ehlers-Danlos syndrome, type 4 |
| 587779593 | COL3A1 | NM_000090.3(COL3A1):c. 836G>A (p.Gly279Asp) | AACAGRTGCTCCTGGATTAAAGG | Ehlers-Danlos syndrome, type 4 |
| 587779595 | COL3A1 | NM_000090.3(COL3A1):c. 2933G>A (p.Gly978Asp) | CAGGRTGAAAGTGGGAAACCAG G | Ehlers-Danlos syndrome, type 4 |
| 587779596 | COL3A1 | NM_000090.3(COL3A1):c. 647G>A (p.Gly216Glu) | CCAGRACCTCCTGTGGTCTATAGG | Ehlers-Danlos syndrome, type 4 |
| 587779599 | COL3A1 | NM_000090.3(COL3A1):c. 2699G>A (p.Gly900Asp) | CCAGRCAAGGATGGGCCCCCAGG | Ehlers-Danlos syndrome, type 4 |
| 587779601 | COL3A1 | NM_000090.3(COL3A1):c. 592G>A (p.Gly198Arg) | CCARGATACCAAGGACCCCCTGG | Ehlers-Danlos syndrome, type 4 |
| 587779606 | COL3A1 | NM_000090.3(COL3A1):c. 2194G>A (p.Gly732Arg) | AGARGAGGTCTTGGAAGTCCTGG | Ehlers-Danlos syndrome, type 4 |
| 587779610 | COL3A1 | NM_000090.3(COL3A1):c. 3284G>A (p.Gly1095Asp) | AAAGRTGAAACAGGTGAACGTG G | Ehlers-Danlos syndrome, type 4 |
| 587779611 | COL3A1 | NM_000090.3(COL3A1):c. 1898G>A (p.Gly633Glu) | ACAGRACCCCTGGTCCACAAGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779621 | COL3A1 | NM_000090.3(COL3A1):c.1358G>A (p.Gly453Asp) | GCTGRTATTCCAGGTGTTCCAGG | Ehlers-Danlos syndrome, type 4 |
| 587779625 | COL3A1 | NM_000090.3(COL3A1):c.709G>A (p.Gly237Arg) | CCCRGACGACCTGGAGAGCGAG G | Thoracic aortic aneurysms and aortic dissections, Ehlers-Danlos syndrome, type 4 |
| 587779626 | COL3A1 | NM_000090.3(COL3A1):c.611G>A (p.Gly204Asp) | CCTGRTGAACCTGGGCAAGCTGG | Ehlers-Danlos syndrome, type 4 |
| 587779630 | COL3A1 | NM_000090.3(COL3A1):c.2293G>A (p.Gly765Ser) | ACTRGTCCTATTGGTCCTCCTGG | Ehlers-Danlos syndrome, type 4 |
| 587779631 | COL3A1 | NM_000090.3(COL3A1):c.1267G>A (p.Gly423Ser) | AATRGTGCTCCTGGACTGCCAGG | Ehlers-Danlos syndrome, type 4 |
| 587779633 | COL3A1 | NM_000090.3(COL3A1):c.1384G>A (p.Gly462Ser) | AAARGCGAAGATGGCAAGGATG G, AGCTAAARGCGAAGATGGCAAG G | Ehlers-Danlos syndrome, type 4 |
| 587779634 | COL3A1 | NM_000090.3(COL3A1):c.1844G>A (p.Gly615Glu) | CTGRACCTCAGGGACCCCCAGGG, ACTGRACCTCAGGGACCCCCAGG | Ehlers-Danlos syndrome, type 4 |
| 587779637 | COL3A1 | NM_000090.3(COL3A1):c.1249G>A (p.Gly417Arg) | CCARGACCAGCCGGTGCTAATGG | Ehlers-Danlos syndrome, type 4 |
| 587779638 | COL3A1 | NM_000090.3(COL3A1):c.2176G>A (p.Gly726Arg) | CAARGAATGCCTGAGAAAGAG | Ehlers-Danlos syndrome, type 4 |
| 587779641 | COL3A1 | NM_000090.3(COL3A1):c.593G>A (p.Gly198Glu) | CCAGRATACCAAGGACCCCCTGG | Ehlers-Danlos syndrome, type 4 |
| 587779642 | COL3A1 | NM_000090.3(COL3A1):c.2501G>A (p.Gly834Asp) | AAAGRTGAAGGAGGCCCTCCTGG | Ehlers-Danlos syndrome, type 4 |
| 587779644 | COL3A1 | NM_000090.3(COL3A1):c.827G>A (p.Gly276Asp) | AAGGRTGAAACAGGTGCTCCTGG | Ehlers-Danlos syndrome, type 4 |
| 587779648 | COL3A1 | NM_000090.3(COL3A1):c.3419G>A (p.Gly1140Glu) | TAGGRACCTGTTGGACCCAGTGG | Ehlers-Danlos syndrome, type 4 |
| 587779650 | COL3A1 | NM_000090.3(COL3A1):c.970G>A (p.Gly324Ser) | GACRGTGCTCGAGGCAGTGATGG | Ehlers-Danlos syndrome, type 4 |
| 587779656 | COL3A1 | NM_000090.3(COL3A1):c.701G>A (p.Gly234Asp) | TCAGRTAGACCCGGACGACCTGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779662 | COL3A1 | NM_000090.3(COL3A1):c.2753G>A (p.Gly918Glu) | CCTGRAGTGTCTGGACCAAAAGG | Ehlers-Danlos syndrome, type 4 |
| 587779672 | COL3A1 | NM_000090.3(COL3A1):c.3266G>A (p.Gly1089Asp) | CAAGRCCCACGTGTGGTGACAAAGG | Ehlers-Danlos syndrome, type 4 |
| 587779673 | COL3A1 | NM_000090.3(COL3A1):c.998G>A (p.Gly333Asp) | CAGGRCCCTCCTGGTCCTCCTGG | Ehlers-Danlos syndrome, type 4 |
| 587779674 | COL3A1 | NM_000090.3(COL3A1):c.2860G>A (p.Gly954Arg) | ACTRGAGCACGGGGTCTTGCAGG | Ehlers-Danlos syndrome, type 4 |
| 587779678 | COL3A1 | NM_000090.3(COL3A1):c.2141G>A (p.Gly714Glu) | CCTGRGCCACCTGGTGCTGCTGG | Ehlers-Danlos syndrome, type 4 |
| 587779680 | COL3A1 | NM_000090.3(COL3A1):c.2186G>A (p.Gly729Glu) | CCTGRAGAAGAGAGGAGGTCTTGG | Ehlers-Danlos syndrome, type 4 |
| 587779683 | COL3A1 | NM_000090.3(COL3A1):c.3544G>A (p.Gly1182Arg) | CCARGGCAACCAGGCCCCTCCTGG | Ehlers-Danlos syndrome, type 4 |
| 587779689 | COL3A1 | NM_000090.3(COL3A1):c.2402G>A (p.Gly801Asp) | AGAGRTGAAACTGGCCCTCCAGG | Ehlers-Danlos syndrome, type 4 |
| 587779691 | COL3A1 | NM_000090.3(COL3A1):c.1763G>A (p.Gly588Asp) | TAGGRTGCTCCTGGTAAGAATGG | Ehlers-Danlos syndrome, type 4 |
| 587779692 | COL3A1 | NM_000090.3(COL3A1):c.1258G>A (p.Gly420Ser) | GCCRGTGCTAATGCTGCTCCTGG | Ehlers-Danlos syndrome, type 4 |
| 587779693 | COL3A1 | NM_000090.3(COL3A1):c.1556G>A (p.Gly519Glu) | AGAGRAGCTGCTGAGAACCTGG | Ehlers-Danlos syndrome, type 4 |
| 587779695 | COL3A1 | NM_000090.3(COL3A1):c.2131G>A (p.Gly711Ser) | GCTRGTCCTCCTGGGCCACCTGG | Ehlers-Danlos syndrome, type 4 |
| 587779696 | COL3A1 | NM_000090.3(COL3A1):c.1096G>A (p.Gly366Arg) | CCTRGACAAAGAGGAGAACCTGG | Ehlers-Danlos syndrome, type 4 |
| 587779698 | COL3A1 | NM_000090.3(COL3A1):c.2177G>A (p.Gly726Glu) | CAAGRAATGCCTGGAGAAAGAGG | Ehlers-Danlos syndrome, type 4 |
| 587779706 | COL3A1 | NM_000090.3(COL3A1):c.2096G>A (p.Gly699Asp) | GCTGRTCCCCTGGTCCCGAAGG | Ehlers-Danlos syndrome, type 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779711 | COL3A1 | NM_000090.3(COL3A1):c.610G>A (p.Gly204Ser) | CCTRGTGAACCTGGGCAAGCTGG | Ehlers-Danlos syndrome, type 4 |
| 587779714 | COL3A1 | NM_000090.3(COL3A1):c.539G>A (p.Gly180Asp) | CCAGRCCCTCCCGGTCCCCCTGG | Ehlers-Danlos syndrome, type 4 |
| 587779716 | COL3A1 | NM_000090.3(COL3A1):c.2735G>A (p.Gly912Asp) | ACTGRTGCTCCTGGCAGCCCTGG | Ehlers-Danlos syndrome, type 4 |
| 587779718 | COL3A1 | NM_000090.3(COL3A1):c.799G>A (p.Gly267Ser) | TAGRGCTTCGATGGACGAAATGG | Ehlers-Danlos syndrome, type 4 |
| 587779723 | COL3A1 | NM_000090.3(COL3A1):c.2914G>A (p.Gly972Ser) | CCCTRGCCCTCAGGGTGTCAAGG | Ehlers-Danlos syndrome, type 4 |
| 112456072 | COL3A1 | NM_000090.3(COL3A1):c.3563G>A (p.Gly1188Glu) | CCTGRACCTCCTGGTGCCCCTGG | Ehlers-Danlos syndrome, type 4 |
| 794728060 | COL3A1 | NM_000090.3(COL3A1):c.4087C>T (p.Arg1363Ter) | CCTTCGACTTCTCTCCAGCYGAG | Thoracic aortic aneurysms and aortic dissections |
| 587779527 | COL3A1 | NM_000090.3(COL3A1):c.1786C>T (p.Arg596Ter) | CCTGGTAAGAATGGAGAAYGAGG | Ehlers-Danlos syndrome, type 4 |
| 672601346 | COL4A1 | NM_001845.5(COL4A1):c.2263G>A (p.Gly755Arg) | CCCRGGGAGAGGGGAGCATTGG | Brain small vessel disease with hemorrhage |
| 672601349 | COL4A1 | NM_001845.5(COL4A1):c.2122G>A (p.Gly708Arg) | ATGRGGCCACCGGGGACTCCAGG | Brain small vessel disease with hemorrhage |
| 121912857 | COL4A1 | NM_001845.5(COL4A1):c.1685G>A (p.Gly562Glu) | CCTGRAAGAGATGGCCATCCGGG, TCCTGRAAGAGATGGCCATCCGG | Brain small vessel disease with hemorrhage |
| 606231465 | COL4A1 | NM_001845.5(COL4A1):c.2194-1G>A | TTTCARGGAGAGCCTGGAGTTGG | Brain small vessel disease with hemorrhage |
| 113994105 | COL4A1 | NM_001845.5(COL4A1):c.1555G>A (p.Gly519Arg) | CCARGGCTGATAGGCCAGCCAGG | Angiopathy, hereditary, with nephropathy, aneurysms, and muscle cramps |
| 113994107 | COL4A1 | NM_001845.5(COL4A1):c.1769G>A (p.Gly590Glu) | CCTGGAGRAGTTGGATTCCCAGG | Brain small vessel disease with hemorrhage |
| 113994108 | COL4A1 | NM_001845.5(COL4A1):c.2159G>A (p.Gly720Asp) | AATGRCTTACCTGGGAACCCAGG | Brain small vessel disease with hemorrhage |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 113994109 | COL4A1 | NM_001845.5(COL4A1):c. 2245G>A (p.Gly749Ser) | CCCRGCATTCCTGGCACACCCGG | Familial porencephaly |
| 113994111 | COL4A1 | NM_001845.5(COL4A1):c. 3389G>A (p.Gly1130Asp) | CCTGTGTCAAAGGAGAAGCAGG | Familial porencephaly |
| 113994112 | COL4A1 | NM_001845.5(COL4A1):c. 3706G>A (p.Gly1236Arg) | AAARGAGACCGCGGACCTCAGG, CAAARGAGACCGCGGACCTCAG G | Familial porencephaly |
| 587777379 | COL4A1 | NM_001845.5(COL4A1):c. 3976G>A (p.Gly1326Arg) | CCTTGATCACCTTTAATTCYCTG | Schizencephaly |
| 387906602 | COL4A2 | NM_001846.2(COL4A2):c. 3455G>A (p.Gly1152Asp) | CAGRCTTTCCAGGGCTGACTGGG, CCAGRCTTTCCAGGGCTGACTGG | Porencephaly 2 |
| 387906603 | COL4A2 | NM_001846.2(COL4A2):c. 3110G>A (p.Gly1037Glu) | AAGGRAGACATCGGAGTCCCCGG | Porencephaly 2 |
| 121912858 | COL4A4 | NM_000092.4(COL4A4):c. 3601G>A (p.Gly1201Ser) | CCTRGTCCAGTGGGAATACCTGG | Alport syndrome, autosomal recessive |
| 121912860 | COL4A4 | NM_000092.4(COL4A4):c. 2690G>A (p.Gly897Glu) | GATGRGCTACCTGGTGCCTCCAGG | Benign familial hematuria |
| 281874656 | COL4A5 | NM_000495.4(COL4A5):c. 1084G>A (p.Gly362Arg) | ATTRGGTTGCCTGGGTTGCCTGG | Alport syndrome, X-linked recessive |
| 281874660 | COL4A5 | NM_000495.4(COL4A5):c. 1216G>A (p.Gly406Ser) | AGGRGTCAGAAAGGTGATGAAG G | Alport syndrome, X-linked recessive |
| 281874663 | COL4A5 | NM_000495.4(COL4A5):c. 1259G>A (p.Gly420Glu) | CCTGRACCTCCTGGACTTGACGG | Alport syndrome, X-linked recessive |
| 281874664 | COL4A5 | NM_000495.4(COL4A5):c. 1294G>A (p.Gly432Arg) | CCTRGGCTTCCAGGGCCTCCTGG | Alport syndrome, X-linked recessive |
| 281874669 | COL4A5 | NM_000495.4(COL4A5):c. 142G>A (p.Gly48Arg) | CAGRGAGAGAGGGTTTCCAG G | Alport syndrome, X-linked recessive |
| 281874671 | COL4A5 | NM_000495.4(COL4A5):c. 1589G>A (p.Gly530Asp) | CAGGRCATTCCAGGAGCTCCAGG | Alport syndrome, X-linked recessive |
| 281874672 | COL4A5 | NM_000495.4(COL4A5):c. 1598G>A (p.Gly533Glu) | CCAGRAGCTCCAGTTGCTCCAGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281874675 | COL4A5 | NM_000495.4(COL4A5):c. 1726G>A (p.Gly576Ser) | CCTRGCACTCCTGGACAGGATGG, TTTACCTRGCACTCCTGGACAGG | Alport syndrome, X-linked recessive |
| 281874677 | COL4A5 | NM_000495.4(COL4A5):c. 1744G>A (p.Gly582Arg) | GATRGATTGCCAGGGCTTCCTGG | Alport syndrome, X-linked recessive |
| 281874680 | COL4A5 | NM_000495.4(COL4A5):c. 1835G>A (p.Gly612Asp) | CAGRCCTCCAGGGAATATAGGG, CCAGRCCTCCAGGGAATATAGG | Alport syndrome, X-linked recessive |
| 281874683 | COL4A5 | NM_000495.4(COL4A5):c. 1904G>A (p.Gly635Asp) | AAAGRCATACAAGGTGTGGCAG, G, TGAAAAAGRCATACAAGGTGTGG | Alport syndrome, X-linked recessive |
| 281874689 | COL4A5 | NM_000495.4(COL4A5):c. 2288G>A (p.Gly763Glu) | CCAGRACTTCCAGGTTTCAAAGG | Alport syndrome, X-linked recessive |
| 281874690 | COL4A5 | NM_000495.4(COL4A5):c. 2305G>A (p.Gly769Arg) | AAAARGAGCACTTGGTCCAAAAGG | Alport syndrome, X-linked recessive |
| 281874695 | COL4A5 | NM_000495.4(COL4A5):c. 2483G>A (p.Gly828Glu) | CCARGAATTCCTGGGCCATAGG | Alport syndrome, X-linked recessive |
| 281874703 | COL4A5 | NM_000495.4(COL4A5):c. 2722G>A (p.Gly908Arg) | CCARGACCTTTGGGAATTCCTGG | Alport syndrome, X-linked recessive |
| 281874704 | COL4A5 | NM_000495.4(COL4A5):c. 2731G>A (p.Gly911Arg) | TTGRGAATTCCTGGCAGGAGTGG, GACCTTTGRGAATTCCTGGCAGG | Alport syndrome, X-linked recessive |
| 281874706 | COL4A5 | NM_000495.4(COL4A5):c. 286G>A (p.Gly96Arg) | CCTRGACTTCCTGGATTTCCAGG | Alport syndrome, X-linked recessive |
| 281874717 | COL4A5 | NM_000495.4(COL4A5):c. 3587G>A (p.Gly1196Glu) | CCTGRACTTCCAGGACTTTCTGG | Alport syndrome, X-linked recessive |
| 281874722 | COL4A5 | NM_000495.4(COL4A5):c. 385G>A (p.Gly129Arg) | TAGRGAGAACGTGGATTTCCAGG | Alport syndrome, X-linked recessive |
| 281874725 | COL4A5 | NM_000495.4(COL4A5):c. 3925-1G>A | TCARGGTAATCCTGGCCGGCCGG, TTATTCARGGTAATCCTGGCCGG | Alport syndrome, X-linked recessive |
| 281874733 | COL4A5 | NM_000495.4(COL4A5):c. 4271G>A (p.Gly1424Glu) | AAAGRAGACCCAGGTCTGCCAGG | Alport syndrome, X-linked recessive |
| 281874739 | COL4A5 | NM_000495.4(COL4A5):c. 438+5G>A | TCCAGTAARTTATAAAATTGGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281874746 | COL4A5 | NM_000495.4(COL4A5):c. 4702G>A (p.Glu1568Lys) | AGTATGTRAAGTCCAGCTGTGG | Alport syndrome, X-linked recessive |
| 281874763 | COL4A5 | NM_000495.4(COL4A5):c. 689G>A (p.Gly230Asp) | CAGGRTGAGCAAGGTCTTCAGGG, ACAGGRTGAGCAAGGTCTTCAGG | Alport syndrome, X-linked recessive |
| 104886080 | COL4A5 | NM_000495.4(COL4A5):c. 892G>A (p.Gly298Ser) | TAGRGTAAACCAGGCAAAGATG G | Alport syndrome, X-linked recessive |
| 104886381 | COL4A5 | NM_000495.4(COL4A5):c. 3554-1G>A | CTGACARGTCAACCAGGCTTTGG | Alport syndrome, X-linked recessive |
| 587776402 | COL4A5 | NM_000495.4(COL4A5):c. 4199-1G>A | GTARGTCCAACTGGCCCTCCAGG | Alport syndrome, X-linked recessive |
| 104886043 | COL4A5 | NM_000495.4(COL4A5):c. 161G>A (p.Gly54Asp) | CCAGRTTTGGAAGGACACCCAGG | Alport syndrome, X-linked recessive |
| 104886057 | COL4A5 | NM_000495.4(COL4A5):c. 593G>A (p.Gly198Glu) | CCCAGRACCACCAGGTTTGATGG | Alport syndrome, X-linked recessive |
| 104886060 | COL4A5 | NM_000495.4(COL4A5):c. 574G>A (p.Gly192Arg) | CCARGGCCAATTGGTCCCCCAGG | Alport syndrome, X-linked recessive |
| 104886061 | COL4A5 | NM_000495.4(COL4A5):c. 584G>A (p.Gly195Asp) | ATTGRTCCCCAGGACCACCAGG | Alport syndrome, X-linked recessive |
| 104886070 | COL4A5 | NM_000495.4(COL4A5):c. 791G>A (p.Gly264Asp) | CCTGRTGACCGAGGGCCTCCTGG | Alport syndrome, X-linked recessive |
| 104886075 | COL4A5 | NM_000495.4(COL4A5):c. 655G>A (p.Gly219Ser) | AATATGRGCTTAAATTTCCAGGG, GAATATGRGCTTAAATTTCCAGG | Alport syndrome, X-linked recessive |
| 104886084 | COL4A5 | NM_000495.4(COL4A5):c. 937G>A (p.Gly313Ser) | AAGRGTTTGCTTGGTGATCTGG | Alport syndrome, X-linked recessive |
| 104886086 | COL4A5 | NM_000495.4(COL4A5):c. 956G>A (p.Gly319Asp) | CCTGRTTACCCTGGTGAACCCGG | Alport syndrome, X-linked recessive |
| 104886091 | COL4A5 | NM_000495.4(COL4A5):c. 974G>A (p.Gly325Glu) | ACCCGRAAGGGATGGTGAAAAG G | Alport syndrome, X-linked recessive |
| 104886096 | COL4A5 | NM_000495.4(COL4A5):c. 1094G>A (p.Gly365Glu) | CCTGRGTTGCCTGGAGAAAAAGG | Alport syndrome, X-linked recessive |
| 104886097 | COL4A5 | NM_000495.4(COL4A5):c. 1112G>A (p.Gly371Glu) | AAAGRAGAGCGAGGATTTCCTGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886098 | COL4A5 | NM_000495.4(COL4A5):c.1139G>A (p.Gly380Asp) | CAGGRTCCACCTGGCCTTCCTGG | Alport syndrome, X-linked recessive |
| 104886101 | COL4A5 | NM_000495.4(COL4A5):c.1226G>A (p.Gly409Asp) | AAAGRTGATGAAGGACCACCTGG | Alport syndrome, X-linked recessive |
| 104886103 | COL4A5 | NM_000495.4(COL4A5):c.1243G>A (p.Gly415Arg) | CCACCTRGAATTTCCATTCCTGG | Alport syndrome, X-linked recessive |
| 104886105 | COL4A5 | NM_000495.4(COL4A5):c.1148G>A (p.Gly383Asp) | CCTGRCCTTCCTGGACCTCCAGG | Alport syndrome, X-linked recessive |
| 104886107 | COL4A5 | NM_000495.4(COL4A5):c.1199G>A (p.Gly400Glu) | CCTGRATTTCCTGGAGAAGGGG, TCCTGRATTTCCTGGAGAAAGGG, CTCCTGRATTTCCTGGAGAAAGG | Alport syndrome, X-linked recessive |
| 104886110 | COL4A5 | NM_000495.4(COL4A5):c.1268G>A (p.Gly423Glu) | CTGRACTTGACGGACAGCCTGGG, CCTGRACTTGACGGACAGCCTGG | Alport syndrome, X-linked recessive |
| 104886111 | COL4A5 | NM_000495.4(COL4A5):c.1276G>A (p.Gly426Arg) | GACRGACAGCCTGGGGCTCCTGG | Alport syndrome, X-linked recessive |
| 104886112 | COL4A5 | NM_000495.4(COL4A5):c.1286G>A (p.Gly429Glu) | CTGRGGCTCCTGGGCTTCCAGGG, CCTGRGGCTCCTGGGCTTCCAGG | Alport syndrome, X-linked recessive |
| 104886114 | COL4A5 | NM_000495.4(COL4A5):c.1397G>A (p.Gly466Glu) | AAAGRACTCCAAGGAGAACAAGG | Alport syndrome, X-linked recessive |
| 104886115 | COL4A5 | NM_000495.4(COL4A5):c.1406G>A (p.Gly469Glu) | CAAGRAGACAAGGAGTGAAAGG | Alport syndrome, X-linked recessive |
| 104886117 | COL4A5 | NM_000495.4(COL4A5):c.1472G>A (p.Gly491Glu) | TCAGRGGCCTCCAGGTCAACCTGG | Alport syndrome, X-linked recessive |
| 104886118 | COL4A5 | NM_000495.4(COL4A5):c.1481G>A (p.Gly494Asp) | CCAGRTCACCTGGTTTGCCAGG | Alport syndrome, X-linked recessive |
| 104886122 | COL4A5 | NM_000495.4(COL4A5):c.1562G>A (p.Gly521Asp) | GCTGRTGCAACTGGTCCCAAAGG | Alport syndrome, X-linked recessive |
| 104886125 | COL4A5 | NM_000495.4(COL4A5):c.1607G>A (p.Gly536Asp) | CCAGRTGCTCCAGGCTTTCCTGG | Alport syndrome, X-linked recessive |
| 104886130 | COL4A5 | NM_000495.4(COL4A5):c.1736G>A (p.Gly579Glu) | CTGRACAGGATGGATTGCCAGGG, CCTGRACAGGATGGATTGCCAGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886131 | COL4A5 | NM_000495.4(COL4A5):c. 1780G>A (p.Gly594Ser) | TAGRTGGAATTACTTTAAGGG, TTAGRGTGGAATTACTTTTAAGG | Alport syndrome, X-linked recessive |
| 104886132 | COL4A5 | NM_000495.4(COL4A5):c. 1783G>A (p.Gly595Arg) | TAGGGTRGAATTACTTTTAAGGG, TTAGGGTRGAATTACTTTTAAGG | Alport syndrome, X-linked recessive |
| 104886136 | COL4A5 | NM_000495.4(COL4A5):c. 1681G>A (p.Gly561Arg) | AAARGAGAGTTGGGTTCCCCTGG | Alport syndrome, X-linked recessive |
| 104886138 | COL4A5 | NM_000495.4(COL4A5):c. 1718G>A (p.Gly573Asp) | CCTGRTTTACCTGGCACTCCTGG | Alport syndrome, X-linked recessive |
| 104886139 | COL4A5 | NM_000495.4(COL4A5):c. 1735G>A (p.Gly579Arg) | CCTRGACAGGATGGATTGCCAGG | Alport syndrome, X-linked recessive |
| 104886142 | COL4A5 | NM_000495.4(COL4A5):c. 1871G>A (p.Gly624Asp) | CCCCCTGRTTTCGGCCCTCCAGG | Alport syndrome, X-linked recessive |
| 104886144 | COL4A5 | NM_000495.4(COL4A5):c. 1886G>A (p.Gly629Asp) | CCAGRCCCAGTAGGTGAAAAAG G | Alport syndrome, X-linked recessive |
| 104886145 | COL4A5 | NM_000495.4(COL4A5):c. 1895G>A (p.Gly632Asp) | GTAGRTGAAAAAGGCATACAAG G | Alport syndrome, X-linked recessive |
| 104886146 | COL4A5 | NM_000495.4(COL4A5):c. 1897G>A (p.Glu633Lys) | GTAGGTRAAAAAGGCATACAAG G | Alport syndrome, X-linked recessive |
| 104886147 | COL4A5 | NM_000495.4(COL4A5):c. 1912G>A (p.Gly638Ser) | CAAARGTGTGCAGGAAATCCAGG | Alport syndrome, X-linked recessive |
| 104886157 | COL4A5 | NM_000495.4(COL4A5):c. 2023G>A (p.Gly675Ser) | GATRGTGATGTAGGTCTTCCAGG | Alport syndrome, X-linked recessive |
| 104886158 | COL4A5 | NM_000495.4(COL4A5):c. 2042G>A (p.Gly681Asp) | TAGRTGACCCTGGACTTCCAGGG, ATAGRTGACCCTGGACTTCCAGG | Alport syndrome, X-linked recessive |
| 104886163 | COL4A5 | NM_000495.4(COL4A5):c. 2165G>A (p.Gly722Glu) | CAGRACCTCCAGGAGCACCTGGG, CCAGRACCTCCAGGAGCACCTGG | Alport syndrome, X-linked recessive |
| 104886165 | COL4A5 | NM_000495.4(COL4A5):c. 2219G>A (p.Gly740Glu) | CCTGRGCCACCCGGCTTTCCAGG | Alport syndrome, X-linked recessive |
| 104886166 | COL4A5 | NM_000495.4(COL4A5):c. 2228G>A (p.Gly743Asp) | ACCCGRCTTTCCAGGACCAAAGG | Alport syndrome, X-linked recessive |
| 104886168 | COL4A5 | NM_000495.4(COL4A5):c. 2060G>A (p.Gly687Glu) | CAGRGCAACCAGGCTTGCCAGGG, CCAGRGCAACCAGGCTTGCCAGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886171 | COL4A5 | NM_000495.4(COL4A5):c. 2287G>A (p.Gly763Arg) | CCARGACTTCCAGGTTTCAAAGG | Alport syndrome, X-linked recessive |
| 104886172 | COL4A5 | NM_000495.4(COL4A5):c. 2297G>A (p.Gly766Asp) | CCAGRTTTCAAAGGAGCACTTGG | Alport syndrome, X-linked recessive |
| 104886174 | COL4A5 | NM_000495.4(COL4A5):c. 2332G>A (p.Gly778Ser) | CGTRGTTTCCAGGACCTCCGGG, TCGTRGTTTCCAGGACCTCCGG | Alport syndrome, X-linked recessive |
| 104886177 | COL4A5 | NM_000495.4(COL4A5):c. 2386G>A (p.Gly796Arg) | CCCTRGACCAAAAGGTATGGAGG GCTCCCTRGACCAAAAGGTATGG | Alport syndrome, X-linked recessive |
| 104886179 | COL4A5 | NM_000495.4(COL4A5):c. 2404G>A (p.Gly802Arg) | GTTRGACCAAATGGACAACCTGG | Alport syndrome, X-linked recessive |
| 104886180 | COL4A5 | NM_000495.4(COL4A5):c. 2423G>A (p.Gly808Glu) | CTGRACCAATGGGACCTCCTGGG, CCTGRACCAATGGGACCTCCTGG | Alport syndrome, X-linked recessive |
| 104886182 | COL4A5 | NM_000495.4(COL4A5):c. 2431G>A (p.Gly811Arg) | ATGRGACCTCCTGGGCTGCCAGG | Alport syndrome, X-linked recessive |
| 104886186 | COL4A5 | NM_000495.4(COL4A5):c. 2554G>A (p.Gly852Arg) | CCTCCTRGACTTGATGTTCCAGG | Alport syndrome, X-linked recessive |
| 104886187 | COL4A5 | NM_000495.4(COL4A5):c. 2555G>A (p.Gly852Glu) | CCTCCTGRACTTGATGTTCCAGG | Alport syndrome, X-linked recessive |
| 104886188 | COL4A5 | NM_000495.4(COL4A5):c. 2597G>A (p.Gly866Glu) | CCAGRGATCCCGGAGCACCTGG | Alport syndrome, X-linked recessive |
| 104886189 | COL4A5 | NM_000495.4(COL4A5):c. 2605G>A (p.Gly869Arg) | CCCRGAGCACCTGGTCCTATAGG | Alport syndrome, X-linked recessive |
| 104886191 | COL4A5 | NM_000495.4(COL4A5):c. 2624G>A (p.Gly875Glu) | TAGRACCTCCAGGATCACCAGGG, ATAGRACCTCCAGGATCACCAGG | Alport syndrome, X-linked recessive |
| 104886195 | COL4A5 | NM_000495.4(COL4A5):c. 2804G>A (p.Gly935Asp) | CCTGRCCCTACAGGAGAAAAGG | Alport syndrome, X-linked recessive |
| 104886210 | COL4A5 | NM_000495.4(COL4A5):c. 3088G>A (p.Gly1030Ser) | ATCRGTGATATGGGTTTCCAGG | Alport syndrome, X-linked recessive |
| 104886214 | COL4A5 | NM_000495.4(COL4A5):c. 3115G>A (p.Gly1039Ser) | CAGRGTGTGAAGGCCTCCTGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886215 | COL4A5 | NM_000495.4(COL4A5):c.3134G>A (p.Gly1045Glu) | CCTGRACCTTCTGGAGTTCCTGG | Alport syndrome, X-linked recessive |
| 104886223 | COL4A5 | NM_000495.4(COL4A5):c.3247G>A (p.Gly1083Ser) | CAGRGTGAGCCTGGTCTGCCTGG | Alport syndrome, X-linked recessive |
| 104886225 | COL4A5 | NM_000495.4(COL4A5):c.3319G>A (p.Gly1107Arg) | CCCRGATTACCAGGAACCCCTGG | Alport syndrome, X-linked recessive |
| 104886228 | COL4A5 | NM_000495.4(COL4A5):c.3427G>A (p.Gly1143Ser) | CCCRGCCTTCCAGGAGAACCTGG | Alport syndrome, X-linked recessive |
| 104886229 | COL4A5 | NM_000495.4(COL4A5):c.3428G>A (p.Gly1143Asp) | CCCGRCCTTCCAGGAGAACCTGG | Alport syndrome, X-linked recessive |
| 104886232 | COL4A5 | NM_000495.4(COL4A5):c.3257G>A (p.Gly1086Asp) | CTGRTCTGCCTGGATACCCAGGG, CCTGRTCTGCCTGGATACCCAGG | Alport syndrome, X-linked recessive |
| 104886235 | COL4A5 | NM_000495.4(COL4A5):c.3481G>A (p.Gly1161Arg) | CCARGGCCTCCAGGACGAAAAAG G | Alport syndrome, X-linked recessive |
| 104886236 | COL4A5 | NM_000495.4(COL4A5):c.3499G>A (p.Gly1167Ser) | AAARGCAAACCCGGTCAAGATG G | Alport syndrome, X-linked recessive |
| 104886237 | COL4A5 | NM_000495.4(COL4A5):c.3508G>A (p.Gly1170Ser) | CCCRGTCAAGATGGTATTCCTGG | Alport syndrome, X-linked recessive |
| 104886240 | COL4A5 | NM_000495.4(COL4A5):c.3535G>A (p.Gly1179Arg) | GCTRGACAGAAGGGTGAACCAG G | Alport syndrome, X-linked recessive |
| 104886244 | COL4A5 | NM_000495.4(COL4A5):c.3586G>A (p.Gly1196Arg) | CCTRGACTTCCAGGACTTTCTGG | Alport syndrome, X-linked recessive |
| 104886247 | COL4A5 | NM_000495.4(COL4A5):c.3632G>A (p.Gly1211Glu) | CCTGRGATTCCAGGAGAAATCTGG | Alport syndrome, X-linked recessive |
| 104886248 | COL4A5 | NM_000495.4(COL4A5):c.3641G>A (p.Gly1214Glu) | CCAGRAAATCCTGGCCTTCCAGG | Alport syndrome, X-linked recessive |
| 104886250 | COL4A5 | NM_000495.4(COL4A5):c.3694G>A (p.Gly1232Ser) | CCTRGTGTGCAGGGTCCCCCAGG | Alport syndrome, X-linked recessive |
| 104886251 | COL4A5 | NM_000495.4(COL4A5):c.3659G>A (p.Gly1220Asp) | CCAGRTCCAAAGGGCGAACCAG G | Alport syndrome, X-linked recessive |
| 104886253 | COL4A5 | NM_000495.4(COL4A5):c.3686G>A (p.Gly1229Asp) | CACGRTTTCCTGGTGTGCAGGG, TCACGRTTTCCTGGTGTGCAGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104886257 | COL4A5 | NM_000495.4(COL4A5):c.3808G>A (p.Gly1270Ser) | GAARGTCCTCCAGGTCTCCCTGG | Alport syndrome, X-linked recessive |
| 104886261 | COL4A5 | NM_000495.4(COL4A5):c.3731G>A (p.Gly1244Asp) | TCTCCGGRTCCAGCTCTGGAAGG | Alport syndrome, X-linked recessive |
| 104886262 | COL4A5 | NM_000495.4(COL4A5):c.3754G>A (p.Gly1252Ser) | AAARGCAACCCTGGGCCCCAAGG | Alport syndrome, X-linked recessive |
| 104886263 | COL4A5 | NM_000495.4(COL4A5):c.3763G>A (p.Gly1255Arg) | CCTRGGCCCCAAGGTCCTCCTGG | Alport syndrome, X-linked recessive |
| 104886279 | COL4A5 | NM_000495.4(COL4A5):c.4342G>A (p.Gly1448Ser) | CAARGTCCCCAGGTCCCCCTGG | Alport syndrome, X-linked recessive |
| 104886297 | COL4A5 | NM_000495.4(COL4A5):c.4787G>A (p.Gly1596Asp) | GATTGRTATTCCTTCATGATGG | Alport syndrome, X-linked recessive |
| 104886331 | COL4A5 | NM_000495.4(COL4A5):c.1516+1G>A | TCCAGRTAAATTATGCCTCAGGG, CTCCAGRTAAATTATGCCTCAGG | Alport syndrome, X-linked recessive |
| 104886338 | COL4A5 | NM_000495.4(COL4A5):c.1780-1G>A | TTARGGTGGAATTACTTTTAAGG | Alport syndrome, X-linked recessive |
| 104886361 | COL4A5 | NM_000495.4(COL4A5):c.2705G>A (p.Gly902Glu) | ATGGRACCTCCAGGCCCACCAGG | Alport syndrome, X-linked recessive |
| 104886363 | COL4A5 | NM_000495.4(COL4A5):c.2732G>A (p.Gly911Glu) | TTGGRAATTCCTGGCAGGAGTGG | Alport syndrome, X-linked recessive |
| 104886370 | COL4A5 | NM_000495.4(COL4A5):c.2840G>A (p.Gly947Asp) | CCTGRCCTTCCAGGCCCTCCTGG | Alport syndrome, X-linked recessive |
| 104886378 | COL4A5 | NM_000495.4(COL4A5):c.3017-1G>A | CTARGTCCCAAAGGTAACCCTGG | Alport syndrome, X-linked recessive |
| 104886384 | COL4A5 | NM_000495.4(COL4A5):c.3605-1G>A | ATARGCCAAAAGGGTGATGAGG, TTCATARGCCAAAAGGGTGATGG | Alport syndrome, X-linked recessive |
| 104886396 | COL4A5 | NM_000495.4(COL4A5):c.385-719G>A | CAAGRTGGAGAGAAGGGTATTG G | Alport syndrome, X-linked recessive |
| 794727397 | COL4A5 | NM_000495.4(COL4A5):c.1844G>A (p.Gly615Glu) | CCAGRGAATATAGGGCCTATGGG, CCCAGRGAATATAGGGCCTATGG | Alport syndrome, X-linked recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 281874676 | COL4A5 | NM_000495.4(COL4A5):c. 1738C>T (p.Gln580Ter) | CCTGCCACTCCTGGAYAGGATGG | Alport syndrome, X-linked recessive |
| 281874681 | COL4A5 | NM_000495.4(COL4A5):c. 1856C>T (p.Pro619Leu) | CCCAGGGAATATAGGGCYTATGG, CCAGGGAATATAGGGCYTATGGG | Alport syndrome, X-linked recessive |
| 281874727 | COL4A5 | NM_000495.4(COL4A5):c. 4147C>T (p.Gln1383Ter) | CCTCCAGGAATCCCTGGCYAGCC, CCAGAATCCCTGGCYAGCCTGG | Alport syndrome, X-linked recessive |
| 281874661 | COL4A5 | NM_000495.4(COL4A5):c. 1219C>T (p.Gln407Ter) | CCTGGAGAAAGGGGTYAGAAAG G | Alport syndrome, X-linked recessive |
| 104886094 | COL4A5 | NM_000495.4(COL4A5):c. 1117C>T (p.Arg373Ter) | CCTGAGAAAAAGGAGGAGYGAG G | Alport syndrome, X-linked recessive |
| 104886207 | COL4A5 | NM_000495.4(COL4A5):c. 3046C>T (p.Gln1016Ter) | CCCTGGTCTCCCTGGAYAGCCAG, CCTGGTCTCCCTGGAYAGCCAGG | Alport syndrome, X-linked recessive |
| 104886213 | COL4A5 | NM_000495.4(COL4A5):c. 3181C>T (p.Gln1061Ter) | CCCCAGGATTACCTGGAYAGAAA, CCAGGATTACCTGGAYAGAAAG, CCAGGATTACCTGGAYAGAAAG G | Alport syndrome, X-linked recessive |
| 104886241 | COL4A5 | NM_000495.4(COL4A5):c. 3538C>T (p.Gln1180Ter) | CCTGACCAGCTGGAYAGAAGG G | Alport syndrome, X-linked recessive |
| 104886270 | COL4A5 | NM_000495.4(COL4A5):c. 4228C>T (p.Arg1410Cys) | CCCTCCAGGAGATCCTGGAYGCA, CCTCCAGGAGATCCTGGAYGCAA, CCAGGAGATCCTGGAYGCAATGG | Alport syndrome, X-linked recessive |
| 104886286 | COL4A5 | NM_000495.4(COL4A5):c. 4687C>T (p.Arg1563Ter) | CCAGCCATTCATTAGTYGGTAAG | Alport syndrome, X-linked recessive |
| 61735045 | COL5A1 | NM_000093.4(COL5A1):c. 1588G>A (p.Gly530Ser) | GGCRGCGATGCGGGCTCCAAAGG | Ehlers-Danlos syndrome, classic type, not specified |
| 121912935 | COL6A1 | NM_001848.2(COL6A1):c. 1022G>A (p.Gly341Asp) | CCAGRCCTGCCAGCTGCAAGGG, CCCAGRCCTGCCAGGCTGCAAGG | Bethlem myopathy |
| 794727788 | COL6A2 | NM_001849.3(COL6A2):c. 812G>A (p.Gly271Asp) | AAGGRCAACAATGGGTGAGCCGG G, CAAGGRCAACATGGGTGAGCCG G | Ullrich congenital muscular dystrophy, Bethlem myopathy |
| 121912940 | COL6A2 | NM_001849.3(COL6A2):c. 811G>A (p.Gly271Ser) | AAGRGCAACATGGGTGAGCCGG G, | Bethlem myopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| | | | CAAGRGCAACATGGGTGAGCCG G | |
| 727502827 | COL6A2 | NM_001849.3(COL6A2):c. 857G>A (p.Gly286Glu) | CAGGRAGAGACCCGGGCATCGAAG G | Congenital muscular dystrophy |
| 727502828 | COL6A2 | NM_001849.3(COL6A2):c. 874G>A (p.Gly292Ser) | GAARGCCCCATTGGATTCCCAGG | Congenital muscular dystrophy |
| 267606750 | COL6A2 | NM_001849.3(COL6A2):c. 1861G>A (p.Asp621Asn) | ATCRACAGCTCCGAGAGCATTGG | Congenital muscular dystrophy, Bethlem myopathy |
| 398123646 | COL6A2 | NM_001849.3(COL6A2):c. 1522-1G>A | TCCTCCARGGAGACCCCGGCAGG | Ullrich congenital muscular dystrophy, Bethlem myopathy, not provided |
| 376880198 | COL6A2 | NM_001849.3(COL6A2):c. 2527C>T (p.Arg843Trp) | CCTGCTGGACGGCTCCGAGYGGC | |
| 121912942 | COL6A2 | NM_001849.3(COL6A2):c. 2455C>T (p.Gln819Ter) | CCCAGACCTTCCCTGCYAAACAG, CCAGACCTTCCCTGCYAAACAGG | Myosclerosis, autosomal recessive |
| 117725825 | COL6A2 | NM_001849.3(COL6A2):c. 2795C>T (p.Pro932Leu) | CCATCGTGCCAGCCYGCGTGGC | Congenital muscular dystrophy, Bethlem myopathy, not provided |
| 794727188 | COL6A3 | NM_004369.3(COL6A3):c. 6239G>A (p.Gly2080Asp) | AACGRCACTCAAGGTTTCCAGGG, GAACRCACTCAAGGTTTCCAGG | Bethlem myopathy |
| 398124128 | COL6A3 | NM_004369.3(COL6A3):c. 6282+1G>A | AAGRTGAGGCGTGGTGATGGG G, AAAGRTGAGGCGTGGGTGATGG G, TAAAGRTGAGGCGTGGGTGATGG | not provided |
| 121434554 | COL6A3 | NM_004369.3(COL6A3):c. 1393C>T (p.Arg465Ter) | CCAACTTCAATGCCATCYGAGAC | Ullrich congenital muscular dystrophy |
| 121912829 | COL7A1 | NM_000094.3(COL7A1):c. 6118G>A (p.Gly2040Ser) | CCTRGTATTCCCGGGCTCCCAGG | Generalized dominant dystrophic epidermolysis bullosa |
| 121912832 | COL7A1 | NM_000094.3(COL7A1):c. 6007G>A (p.Gly2003Arg) | CGCRGGCTGAAGGGCGACCGTGG | Dominant dystrophic epidermolysis bullosa with absence of skin |
| 121912836 | COL7A1 | NM_000094.3(COL7A1):c. 6127G>A (p.Gly2043Arg) | CCCRGGCTCCCAGGCAGGGCTGG, TATTCCCRGGCTCCCAGGCAGGG, GTATTCCCRGGCTCCCAGGCAGG | Generalized dominant dystrophic epidermolysis bullosa |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912837 | COL7A1 | NM_000094.3(COL7A1):c. 6724G>A (p.Gly2242Arg) | CAGRGGTCTCCAGGTTTGCCTGG | |
| 121912838 | COL7A1 | NM_000094.3(COL7A1):c. 6091G>A (p.Gly2031Ser) | TCCRGCCTTGCCGGGGAGCCTGG | Recessive dystrophic epidermolysis bullosa |
| 121912839 | COL7A1 | NM_000094.3(COL7A1):c. 6859G>A (p.Gly2287Arg) | GTCRGACCTAAAGGAGGAACCTGG | Recessive dystrophic epidermolysis bullosa, Nail disorder, nonsyndromic congenital, 8 |
| 121912842 | COL7A1 | NM_000094.3(COL7A1):c. 6017G>A (p.Gly2006Asp) | AAGGREGACCGTGGAGACCCTGG | Generalized dominant dystrophic epidermolysis bullosa |
| 121912843 | COL7A1 | NM_000094.3(COL7A1):c. 6044G>A (p.Gly2015Glu) | CCCTCAGGRGCCACCTGGTCTGG | Generalized dominant dystrophic epidermolysis bullosa |
| 121912844 | COL7A1 | NM_000094.3(COL7A1):c. 6100G>A (p.Gly2034Arg) | GCCRGGAGCCTGGAAAGCCTGG | Generalized dominant dystrophic epidermolysis bullosa |
| 121912846 | COL7A1 | NM_000094.3(COL7A1):c. 6110G>A (p.Gly2037Glu) | CTGRAAAGCCTGGTATTCCCGGG, CCTGRAAAGCCTGGTATTCCCGG | Generalized dominant dystrophic epidermolysis bullosa |
| 121912850 | COL7A1 | NM_000094.3(COL7A1):c. 6227G>A (p.Gly2076Asp) | GATGRCCCTCCTGGACTCCCTGG | Generalized dominant dystrophic epidermolysis bullosa |
| 121912851 | COL7A1 | NM_000094.3(COL7A1):c. 7957G>A (p.Gly2653Arg) | CCCRGGCTGGCAGGACACAAAG G | Recessive dystrophic epidermolysis bullosa |
| 387906605 | COL7A1 | NM_000094.3(COL7A1):c. 4565G>A (p.Gly1522Glu) | CAGGRGCCACCAGGACCCCACTGG | Transient bullous dermolysis of the newborn |
| 121912847 | COL7A1 | NM_000094.3(COL7A1):c. 4888C>T (p.Arg1630Ter) | CCCAGGACCTGTTGGCCCCYGAG, CCAGGACCTGTTGGCCCCYGAGG | |
| 121912931 | COL9A1 | NM_001851.4(COL9A1):c. 883C>T (p.Arg295Ter) | CCTACCCCTCCAGGGTGACYGAG CCCTCCAGGGTGACYGAGGTCC, CCCTCCAGGGTGACYGAGGTCCT | Stickler syndrome, type 4 |
| 387907076 | COLEC11 | NM_024027.4(COLEC11): c.610G>A (p.Gly204Ser) | CTTCATCRGCATCAACGACCTGG | Carnevale syndrome |
| 312262904 | COMP | NM_000095.2(COMP):c.21 55G>A (p.Gly719Ser) | CATGCGGRGTGGCCGCCTGGGGG, CCATGCGGRGTGGCCGCCTGGGG | Pseudoachondroplastic spondyloepiphyseal dysplasia syndrome |
| 137852655 | COMP | NM_000095.2(COMP):c.21 56G>A (p.Gly719Asp) | CATGCGGGRGTGGCCGCCTGGGGG | Pseudoachondroplastic spondyloepiphyseal dysplasia syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918231 | COQ2 | NM_015697.7(COQ2):c.59 0G>A (p.Arg197His) | GCCAATCRTCCAATAGCCGCTGG | Coenzyme Q10 deficiency, primary 1 |
| 143441644 | COQ4 | NM_016035.4(COQ4):c.71 8C>T (p.Arg240Cys) | CCTGTACTATGAGCGGYGCTGGG | COENZYME Q10 DEFICIENCY, PRIMARY, 7 |
| 397514755 | CORO1A | NM_001193333.2(CORO1 A):c.400G>A (p.Val134Met) | AGCGTRTGGGCATTGTGGCCTGG | Immunodeficiency 8 |
| 28939711 | COX15 | NM_004376.5(COX15):c.6 49C>T (p.Arg217Trp) | CCCATGACATCCCYYGGGTCAGT | Congenital myasthenic syndrome, acetazolamide-responsive, Cardioencephalomyopathy, fatal infantile, due to cytochrome c oxidase deficiency 2 |
| 61733458 | CP | NM_000096.3(CP):c.1652C >T (p.Thr551Ile) | CCARTGAATATATCTTTAGTGGG, CCCARTGAATATATCTTTAGTGG | Deficiency of ferroxidase, not specified |
| 386134156 | CP | NM_000096.3(CP):c.2701C >T (p.Arg901Ter) | CCCCCTGATTGTTTGTYGAAGAC, CCCCTGATTGTTTGTYGAAGACC, CCCTGATTGTTTGTYGAAGACCT | Deficiency of ferroxidase |
| 114402678 | CPA6 | NM_020361.4(CPA6):c.809 C>T (p.Ala270Val) | TTCTATTGRCATCCACTCCACGG | Febrile seizures, familial, 11, not provided |
| 121917866 | CPOX | NM_000097.5(CPOX):c.99 1C>T (p.Arg331Trp) | CCCATCGTGGAGAAYGGCGGGG C | Coproporphyria |
| 121917871 | CPOX | NM_000097.5(CPOX):c.85 C>T (p.Gln29Ter) | CCCCGCGCCTGGTCCYAGTGCGG, CCCGCGCCTGGTCCYAGTGCGGC | Coproporphyria |
| 28936374 | CPT1A | NM_001876.3(CPT1A):c.2 126G>A (p.Gly709Glu) | CAGCCRAGGGGGCTTTGGACCGG | Carnitine palmitoyltransferase I deficiency |
| 80356780 | CPT1A | NM_001876.3(CPT1A):c.2 129G>A (p.Gly710Glu) | CAGCGGAGRGGGCTTTGGACCGG | Carnitine palmitoyltransferase I deficiency |
| 80356794 | CPT1A | NM_001876.3(CPT1A):c.1 425G>A (p.Trp475Ter) | CTGRCCAGATGCGCCGATCTGG | Carnitine palmitoyltransferase I deficiency |
| 80356775 | CPT1A | NM_001876.3(CPT1A):c.3 67C>T (p.Arg123Cys) | CCCTCATCGTCACCATGYGCTAC, CCTCATCGTCACCATGYGCTACT | Carnitine palmitoyltransferase I deficiency, not provided |
| 80356779 | CPT1A | NM_001876.3(CPT1A):c.1 436C>T (p.Pro479Leu) | CCTGGGCAGATGCCYGATCGTG | Carnitine palmitoyltransferase I deficiency, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 727503887 | CPT2 | NM_000098.2(CPT2):c.886 C>T (p.Arg296Ter) | CCTGACCAGTGAGAACYGAGAC A | CARNITINE PALMITOYLTRANSFERASE II DEFICIENCY, LATE-ONSET, Carnitine palmitoyltransferase II deficiency, infantile |
| 74315296 | CPT2 | NM_000098.2(CPT2):c.150 7C>T (p.Arg503Cys) | CCGCACTGAGACCATCYGCCCGG | |
| 28939720 | CRB1 | NM_201253.2(CRB1):c.223 4C>T (p.Thr745Met) | CCATGTTTGTCCGAAYGCTTCAA | Retinitis pigmentosa 12, not provided |
| 730880377 | CRB2 | NM_173689.6(CRB2):c.189 7C>T (p.Arg633Trp) | CCGTTGCGACTGTGCCYGGCCCC | Ventriculomegaly with cystic kidney disease |
| 587783476 | CREBBP | NM_004380.2(CREBBP):c. 286C>T (p.Gln96Ter) | CCAGCAGCCCCGTGYAGCAGGGC | Rubinstein-Taybi syndrome |
| 587783475 | CREBBP | NM_004380.2(CREBBP):c. 2791C>T (p.Gln931Ter) | CCAGGTGACCCGCAGCCTYAAA | Rubinstein-Taybi syndrome |
| 587783479 | CREBBP | NM_004380.2(CREBBP):c. 3310C>T (p.Gln1104Ter) | CCTAGAAGCACTGTATCGAYAGG | Rubinstein-Taybi syndrome |
| 587783490 | CREBBP | NM_004380.2(CREBBP):c. 4078C>T (p.Arg1360Ter) | CCGGGGAGGTTTTTGTCYGAGTG | Rubinstein-Taybi syndrome |
| 587783509 | CREBBP | NM_004380.2(CREBBP):c. 598C>T (p.Gln200Ter) | CCATAGCTTAATTAATYAGGCTT | Rubinstein-Taybi syndrome |
| 587783510 | CREBBP | NM_004380.2(CREBBP):c. 6088C>T (p.Gln2030Ter) | CCCCTTCCCCAGCAGCYAGCCCAT, CCCTTCCCCAGCAGYAGCCCATG | Rubinstein-Taybi syndrome |
| 137853932 | CRLF1 | NM_004750.4(CRLF1):c.39 7+1G>A | TTGGCCRTAAGTTGCACCCAGG | Cold-induced sweating syndrome 1 |
| 137853926 | CRLF1 | NM_004750.4(CRLF1):c.53 8C>T (p.Gln180Ter) | CCCCGCAGGTGGTATGGCYAGGA, CCCCAGGTGGTATGGCYAGGAC, CCGCAGGTGGTATGGCYAGGACA | Cold-induced sweating syndrome 1 |
| 137853930 | CRLF1 | NM_004750.4(CRLF1):c.41 3C>T (p.Pro138Leu) | CCAGTGCCCCAGAGAAACYCGT | Cold-induced sweating syndrome 1 |
| 72659357 | CRTAP | NM_006371.4(CRTAP):c.3 G>A (p.MetIle) | GATRGAGCCGGGCGCCCGGGG, CGATRGAGCCGGGGCGCCGGGG, | Osteogenesis imperfecta type 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| | | | GCGATRGAGCCGGGGCGCCCGG, CGCGATRGAGCCGGGGCGCCGG, GCGCGATRGAGCCGGGGCGCCG, G | |
| 104894672 | CRX | NM_000554.4(CRX):c.121 C>T (p.Arg41Trp) | CCCCCAGGAAGCAGCGGYGGGA, CCCCAGGAAGCAGCGGYGGGAG, C, CCAGGAAGCAGCGGYGGGAGC, G, CCAGGAAGCAGCGGYGGGACG, C | Cone-rod dystrophy 2, not provided |
| 104894673 | CRX | NM_000554.4(CRX):c.268 C>T (p.Arg90Trp) | CCAGTTTGTTCAAGAACYGGA | Leber congenital amaurosis 7, not provided |
| 74315440 | CRYAA | NM_000394.3(CRYAA):c.2 7G>A (p.Trp9Ter) | CCTGRTTCAAGCGCACCCTGGGG, CCCTGRTTCAAGCGCACCCTGGG, CCCCTGRTTCAAGCGCACCCTGG | |
| 397515623 | CRYAA | NM_000394.3(CRYAA):c.1 60C>T (p.Arg54Cys) | CCGCCAGTCCCTCTTCYGCACCG | Cataract, autosomal dominant |
| 397515624 | CRYAA | NM_000394.3(CRYAA):c.3 4C>T (p.Arg12Cys) | CCAGCACCCTGGTTCAAGYGCA | Cataract, autosomal dominant, multiple types, with microcornea |
| 74315439 | CRYAA | NM_000394.3(CRYAA):c.3 46C>T (p.Arg116Cys) | CCCGTGAGTTCCACYGCCGCTAC | Cataract, autosomal dominant |
| 74315441 | CRYAA | NM_000394.3(CRYAA):c.1 45C>T (p.Arg49Cys) | CCATCAGCCCCTACTACYGCCAG | Cataract, autosomal dominant |
| 387907338 | CRYAB | NM_001885.2(CRYAB):c.1 66C>T (p.Arg56Trp) | CCACCCTCCTTCCTGYGGCACC | Posterior polar cataract type 2 |
| 397515555 | CSF1R | NM_005211.3(CSF1R):c.19 58G>A (p.Cys653Tyr) | GCCTRTACCCATGGAGGTAAGGG, AGCCTRTACCCATGGAGGTAAGG | Hereditary diffuse leukoencephalopathy with spheroids |
| 690016564 | CSF1R | NM_005211.3(CSF1R):c.23 50G>A (p.Val784Met) | CGTAACRTGCTGTTGACCAATGG | Hereditary diffuse leukoencephalopathy with spheroids |
| 281860268 | CSF1R | NM_005211.3(CSF1R):c.17 66G>A (p.Gly589Glu) | CCCTCGRAGCTGGAGCCTTTGGG, ACCCTCGRAGCTGGAGCCTTTGG | Hereditary diffuse leukoencephalopathy with spheroids |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515556 | CSF1R | NM_005211.3(CSF1R):c.23 29C>T (p.Arg777Trp) | CCCTCAGTGCATCCACYGGGACG CCTTCAGTGCATCCACYGGGACGT | Hereditary diffuse leukoencephalopathy with spheroids |
| 690016562 | CSF1R | NM_005211.3:c.2467C>T | CCTGTGAAGTGGATGGYCCCAGA | Hereditary diffuse leukoencephalopathy with spheroids |
| 606231473 | CSF3R | NM_000760.3(CSF3R):c.92 2C>T (p.Arg308Cys) | CCTACACCCTGCAGATAYGCTGC | Severe congenital neutropenia |
| 796065343 | CSF3R | NM_156039.3(CSF3R):c.18 53C>T (p.Thr618Ile) | CCCTCACCCTGATGAYCTTGACCC | Early T cell progenitor acute lymphoblastic leukemia |
| 1064039 | CST3 | NM_000099.3(CST3):c.73 G>A (p.Ala25Thr) | CCCCGCGRCCGGCTCCAGTCCCGG | Age-related macular degeneration 11 |
| 545986367 | CSTB | NM_000100.3(CSTB):c.136 C>T (p.Gln46Ter) | CACCTRGCTCTTGAATGACACGG | not provided |
| 387907080 | CTC1 | NM_025099.5(CTC1):c.775 G>A (p.Val259Met) | CCACRTGTCCATCATCGTGCAGG | Cerebroretinal microangiopathy with calcifications and cysts |
| 121913413 | CTNNB1 | NM_001904.3(CTNNB1):c. 122C>T (p.Thr41Ile) | CCATTCTGGTGCCACTAYCACAG | Pilomatrixoma |
| 35086888 | CTNS | NM_001031681.2(CTNS):c. 124G>A (p. Val42Ile) | CCGCAGGGTGAGGCTGAYGTTGG | Cystinosis, atypical nephropathic |
| 515726209 | CTRC | NM_007272.2(CTRC):c.21 7G>A (p.Ala73Thr) | TCACTGCRCCCACTGCATCAGG | Hereditary pancreatitis |
| 121909293 | CTRC | NM_007272.2(CTRC):c.76 0C>T (p.Arg254Trp) | CCGGTAGTCTACACCYGGGTGTC | Hereditary pancreatitis, Pancreatitis, chronic, susceptibility to |
| 104894209 | CTSC | NM_001814.4(CTSC):c.856 C>T (p.Gln286Ter) | CCCCAATCCTAAGCCCTYAGGAG, CCCAATCCTAAGCCCTYAGGAGG, CCAATCCTAAGCCCTYAGGAGGT | Papillon-Lef\xc3\xa8vre syndrome |
| 587779409 | CTSD | NM_001909.4(CTSD):c.47 0C>T (p.Ser157Leu) | CCAGGACACTGTGTYGGTGAGTC | Ceroid lipofuscinosis neuronal 10 |
| 3732378 | CX3CR1 | NM_001171174.1(CX3CR1 ):c.935C>T (p.Thr312Met) | AACCRTCTCAGTCACACTGAGGG, CAACCRTCTCAGTCACACTGAGG | Age-related macular degeneration 12 |
| 3732379 | CX3CR1 | NM_001171174.1(CX3CR1 ):c.841G>A (p. Val281Ile) | CCAGGAAAATCATAAYGTTGTAG | Age-related macular degeneration 12 |
| 104893624 | CXCR4 | NM_003467.2(CXCR4):c.1 000C>T (p.Arg334Ter) | CCTCTCCAAAGGAAAGYAGAGTG | Warts, hypogammaglobulinemia, infections, and myelokathexis |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121965009 | CYB5R3 | NM_000398.6(CYB5R3):c. 316G>A (p.Val106Met) | CTTCRTGGACCTGGTCATCAAGG | METHEMOGLOBINEMIA, TYPE I |
| 61732609 | CYB5R3 | NM_000398.6(CYB5R3):c. 478C>T (p.Arg160Ter) | GTCRGATGGCGAACTTCCCTGGG, GGTCRGATGGCGAACTTCCCTGG | Methemoglobinemia type 2 |
| 121965014 | CYB5R3 | NM_000398.6(CYB5R3):c. 229C>T (p.Gln77Ter) | CCCGTTCTGTCCTGCAGGCYAGC, CCGTTCTGTCCTGCAGGCYAGCA | Methemoglobinemia type 2 |
| 200872504 | CYB5R3 | NM_000398.6(CYB5R3):c. 463+8G>C | CCAAGGGATTCCGACCYGAATCA | Methemoglobinemia type 2 |
| 137854590 | CYBB | NM_000397.3(CYBB):c.46 6G>A (p.Ala156Thr) | TTTTRCTCGAAAGAGAATAAAGG | Granulomatous disease, chronic, X-linked, variant, not provided |
| 104894139 | CYP17A1 | NM_000102.3(CYP17A1):c. 1073G>A (p.Arg358Gln) | TCCRAGAGGTGCTTCGCCTCAGG | Isolated 17,20-lyase deficiency |
| 104894153 | CYP17A1 | NM_000102.3(CYP17A1):c. 287G>A (p.Arg96Gln) | GGGCRGCCTCAAATGGTAAGTGG | Complete combined 17-alpha-hydroxylase/17,20-lyase deficiency |
| 104894154 | CYP17A1 | NM_000102.3(CYP17A1):c. 374G>A (p.Arg125Gln) | GCTGCATCRAAGGCTGGCGATGG | Complete combined 17-alpha-hydroxylase/17,20-lyase deficiency |
| 104894155 | CYP17A1 | NM_000102.3(CYP17A1):c. 1247G>A (p.Arg416His) | AGCRTTTCTTGAATCCAGCCGGG, GAGCRTTTCTTGAATCCAGCGGG, AGAGCRTTTCTTGAATCCAGCGG | Complete combined 17-alpha-hydroxylase/17,20-lyase deficiency |
| 104894142 | CYP17A1 | NM_000102.3(CYP17A1):c. 1084C>T (p.Arg362Cys) | CCATCCGAGAGGTGCTTYGCCTC | Complete combined 17-alpha-hydroxylase/17,20-lyase deficiency |
| 104894145 | CYP17A1 | NM_000102.3(CYP17A1):c. 1283C>T (p.Pro428Leu) | CCCAGCTCATCTCACYGTCAGTA, CCAGCTCATCTCACYGTCAGTAA | Complete combined 17-alpha-hydroxylase/17,20-lyase deficiency |
| 104894149 | CYP17A1 | NM_000102.3(CYP17A1):c. 1039C>T (p.Arg347Cys) | CCAACTATCAGTGACYGTAACCG | Combined partial 17-alpha-hydroxylase/17,20-lyase deficiency |
| 28936700 | CYP1B1 | NM_000104.3(CYP1B1):c. 182G>A (p.Gly61Glu) | ATCGRAAACCGGCGGCGGTGG, GATCGRAAACCGCGGCGGCGTG, ACTGATCGRAAACGCGGCGCGG | Glaucoma, congenital |
| 201824781 | CYP1B1 | NM_000104.3(CYP1B1):c. 155C>T (p.Pro52Leu) | ACGGGCCCRGGGGGCGCGGACCG G | Glaucoma, primary open angle, juvenile-onset |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 79204362 | CYP1B1 | NM_000104.3(CYP1B1):c. 1103G>A (p.Arg368His) | CCCATACAAGGCAGAYGGTCCCT, CCATACAAGGCAGAYGGTCCCTC | Glaucoma, congenital, Coloboma, not provided |
| 151344503 | CYP21A2 | NM_000500.7(CYP21A2):c. 1217G>A (p.Trp406Ter) | GTTCTRGCCTGGTATGTGGGGGG, AGTTCTRGCCTGGTATGTGGGGG, GAGTTCTRGCCTGGTATGTGGGG, TGAGTTCTRGCCTGGTATGTGGG | 21-hydroxylase deficiency |
| 7769409 | CYP21A2 | NM_000500.7(CYP21A2):c. 1069C>T (p.Arg357Trp) | CCGAGGTGCTGCGCCTGYGGCCC | 21-hydroxylase deficiency |
| 6445 | CYP21A2 | NM_000500.7(CYP21A2):c. 1360C>T (p.Pro454Ser) | CCCTTCACGCTGCTGYCCTCCGGG | 21-hydroxylase deficiency |
| 9378251 | CYP21A2 | NM_000500.7(CYP21A2):c. 92C>T (p.Pro31Leu) | CCGGAGCCTCCACCTCCYGCCTC | 21-hydroxylase deficiency |
| 7755898 | CYP21A2 | NM_000500.7(CYP21A2):c. 955C>T (p.Gln319Ter) | CCAGATTCAGCAGCGACTGYAGG | 21-hydroxylase deficiency |
| 387907324 | CYP24A1 | NM_000782.4(CYP24A1):c. 964G>A (p.Glu322Lys) | CACARAGCTCCAGCTGGCTGCGG | Idiopathic hypercalcemia of infancy |
| 121908097 | CYP27A1 | NM_000784.3(CYP27A1):c. 1421G>A (p.Arg474Gln) | TCCRGGCCTGCCTGGGCCGCAGG | Cholestanol storage disease |
| 121908099 | CYP27A1 | NM_000784.3(CYP27A1):c. 1214G>A (p.Arg405Gln) | AAACTCCCRGATCATAGAAAAGG | Cholestanol storage disease |
| 587778797 | CYP27A1 | NM_000784.3(CYP27A1):c. 446+1G>A | CACRTGAGCTGGGGCCTGAAGGG, CCACRTGAGCTGGGGCCTGAAGG | Cholestanol storage disease |
| 376230356 | CYP27A1 | NM_000784.3(CYP27A1):c. 380G>A (p.Arg127Gln) | TACRGAACGACATGGAGCTATGG | Cholestanol storage disease |
| 72551314 | CYP27A1 | NM_000784.3(CYP27A1):c. 475C>T (p.Gln159Ter) | CCACTGGTACCAGCTGCGCYAGG | Cholestanol storage disease |
| 72551316 | CYP27A1 | NM_000784.3(CYP27A1):c. 745C>T (p.Gln249Ter) | CCATCGGGTTAATGTTCYAGAAC | Cholestanol storage disease |
| 121908098 | CYP27A1 | NM_000784.3(CYP27A1):c. 1420C>T (p.Arg474Trp) | CCCTTTGGCTATGGGGTCYGGGC, CCTTTGGCTATGGGGTCYGGGCC | Cholestanol storage disease |
| 587778787 | CYP27A1 | NM_000784.3(CYP27A1):c. 1402C>T (p.Pro468Ser) | CCCATTTGGCTCTGTGYCCTTTG, CCATTTGGCTCTGTGYCCTTTGG | Cholestanol storage disease |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28934604 | CYP27B1 | NM_000785.3(CYP27B1):c.320G>A (p.Arg107His) | AGCRCTGCAGCTTCRCGCCCTGG | Vitamin D-dependent rickets, type 1 |
| 118204008 | CYP27B1 | NM_000785.3(CYP27B1):c.1226C>T (p.Thr409Ile) | CCAGACGCTGGTCAYTCTGTGTC | Vitamin D-dependent rickets, type 1 |
| 118204011 | CYP27B1 | NM_000785.3(CYP27B1):c.1027C>T (p.Leu343Phe) | CCCCGAAGTCCAGACAGCAYTCC, CCCGAAGTCCAGACAGCAYTCCA, CCGAAGTCCAGACAGCAYTCCAC | Vitamin D-dependent rickets, type 1 |
| 199476187 | CYP4V2 | NM_207352.3(CYP4V2):c.283G>A (p.Gly95Arg) | GGTCRGGCCAGTGCCCATGGTGG, CTGGGTCRGGCCAGTGCCCATGG | Bietti crystalline corneoretinal dystrophy |
| 199476198 | CYP4V2 | NM_207352.3(CYP4V2):c.1020G>A (p.Trp340Ter) | AACTGRTCCTTATACCTGTTGGG, AAACTGRTCCTTATACCTGTTGG | Bietti crystalline corneoretinal dystrophy |
| 119103284 | CYP4V2 | NM_207352.3(CYP4V2):c.1523G>A (p.Arg508His) | TTCRTCCAAGTAATGGCATCTGG | Bietti crystalline corneoretinal dystrophy |
| 199476202 | CYP4V2 | NM_207352.3(CYP4V2):c.1187C>T (p.Pro396Leu) | CCTTTTTCCTTCTGTTCYTTTAT | Bietti crystalline corneoretinal dystrophy |
| 121908611 | CYP7B1 | NM_004820.3(CYP7B1):c.1250G>A (p.Arg417His) | TATGATCRTTTTATAGAAGATGG | Spastic paraplegia 5A |
| 72554620 | CYP7B1 | NM_004820.3(CYP7B1):c.1162C>T (p.Arg388Ter) | CCGGGGACTACTGTGTGYGAAAG | Spastic paraplegia 5A, Bile acid synthesis defect, congenital, 3 |
| 193922955 | DAG1 | NM_001165928.3(DAG1):c.575C>T (p.Thr192Met) | CCTGTGACTGTTTTGAYGGTGAT | Limb-girdle muscular dystrophy-dystroglycanopathy, type C9, not provided |
| 121918212 | DARS2 | NM_018122.4(DARS2):c.1837C>T (p.Leu613Phe) | CCTTCCGGGGACATGACYTCATG | Leukoencephalopathy with Brainstem and Spinal Cord Involvement and Lactate Elevation |
| 200670286 | DARS2 | NM_018122.4(DARS2):c.1825C>T (p.Arg609Trp) | CCTTCCCAAAGTCCTTCYGGGGA | Leukoencephalopathy with Brainstem and Spinal Cord Involvement and Lactate Elevation |
| 267606760 | DBH | NM_000787.3(DBH):c.301G>A (p. Val101Met) | CTCRTGGTGCTCTGGACCGATGG | Dopamine beta hydroxylase deficiency |
| 185492864 | DBT | NM_001918.3(DBT):c.901C>T (p.Arg301Cys) | ATTCCACRAGCAAATGCAATGGG, AATTCCACRAGCAAATGCAATGG | Maple syrup urine disease, not provided |
| 72466485 | DCTN1 | NM_004082.4(DCTN1):c.211G>A (p.Gly71Arg) | ATGATRGAACTGTTCAAGGCAGG | Perry syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894779 | DCX | NM_178152.2(DCX):c.184 G>A (p.Asp62Asn) | ATGGGRACCGCTACTTCAAGGGG, AATGGGRACCGCTACTTCAAGGG, CAATGGGRACCGCTACTTCAAGG | Lissencephaly, X-linked, Subcortical laminar heterotopia, X-linked |
| 587783544 | DCX | NM_178151.2(DCX):c.364 G>A (p.Gly122Arg) | AGGAARGTAATTTAAATAGTGGG, GAGGAARGTAATTTAAATAGTGG | Heterotopia |
| 587783527 | DCX | NM_178151.2(DCX):c.182 G>A (p.Gly61Glu) | ATGRGGACCGCTACTTCAAGGGG, AATGRGGACCGCTACTTCAAGGG, CAATCRGGACCGCTACTTCAAGG | Heterotopia |
| 587783589 | DCX | NM_178151.2(DCX):c.809-1G>A | CCARAATGCCGAGTCATGAAGGG, CCCARAATGCCGAGTCATGAAGG | Heterotopia |
| 104894780 | DCX | NM_178151.2(DCX):c.574 C>T (p.Arg192Trp) | CCGAGTGGGGTGAAGCCTYGGA | Lissencephaly, X-linked, Subcortical laminar heterotopia, X-linked, Heterotopia |
| 587783519 | DCX | NM_178151.2(DCX):c.115 C>T (p.Arg39Ter) | CCACTGTAGCTTCTACYGAACC, CCACTGTAGCTTCTACYGAACCA | Heterotopia |
| 587783522 | DCX | NM_178151.2(DCX):c.130 C>T (p.Gln44Ter) | CCGAACCAGAACCTTGYAGGCAC | Heterotopia |
| 587783535 | DCX | NM_178151.2(DCX):c.232 C>T (p.Arg78Cys) | CCTCTTGACCGTTTTYGCAGCTTT | Heterotopia |
| 587783541 | DCX | NM_178151.2(DCX):c.304 C>T (p.Arg102Cys) | CCTGCCTCAGGGAGTGYGTTACA | Heterotopia |
| 587783554 | DCX | NM_178151.2(DCX):c.478 C>T (p.Gln160Ter) | CCAATATGAAAGCCCCCYAGTCC | Heterotopia |
| 587783590 | DCX | NM_178151.2(DCX):c.814 C>T (p.Arg272Ter) | CCTTTTGCCCCAGAATGCYGAGT | Heterotopia |
| 587783592 | DCX | NM_178151.2(DCX):c.907 C>T (p.Arg303Ter) | CCCTGGTCCTATGCGYGAAGCA, CCTGGTCCTATGCGCYGAAGCAA | Heterotopia |
| 121434641 | DDB2 | NM_000107.2(DDB2):c.937C>T (p.Arg313Ter) | CCAGAGAGCGAGATCYGAGTTT | Xeroderma pigmentosum, group E |
| 137853208 | DDC | NM_001082971.1(DDC):c.749C>T (p.Ser250Phe) | CCACAACATGCTGCTYCTTTGAC | Deficiency of aromatic-L-amino-acid decarboxylase |
| 121964863 | DDR2 | NM_001014796.1(DDR2):c.2254C>T (p.Arg752Cys) | CCGGGCAGTGCTCCCTATCYGCT | Spondylometaepiphyseal dysplasia short limb-hand type |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796052231 | DDX3X | NM_001356.4(DDX3X):c.1126C>T (p.Arg376Cys) | CCTCCAAAGGGTGTCYGCCACAC | not provided, MENTAL RETARDATION, X-LINKED 102 |
| 796052234 | DDX3X | NM_001356.4(DDX3X):c.1462C>T (p.Arg488Cys) | CCCTTCACCAGTTCYGCTCAGGA | not provided |
| 796052236 | DDX3X | NM_001356.4(DDX3X):c.1490C>T (p.Ala497Val) | CCCAATTTTAGTGGYTACAGCAG | not provided |
| 587777408 | DEAF1 | NM_021008.3(DEAF1):c.670C>T (p.Arg224Trp) | CCCCRGCCGCCTGCAAGGAAGGG, TCCCCRGCCGCCTGCAAGGAAGG | Mental retardation, autosomal dominant 24 |
| 587777458 | DEPDC5 | NM_001242896.1(DEPDC5):c.3259C>T (p.Arg1087Ter) | CCTACATGGACAGCCCAYGAAAG | Epilepsy, partial, with variable foci |
| 748323823 | DES | NM_001927.3(DES):c.1371+1G>A | GGGAGRTAAGTGGTCTGTCTGGG, GGGGAGRTAAGTGGTCTGTCTGG | not provided |
| 57694264 | DES | NM_001927.3(DES):c.1201G>A (p.Glu401Lys) | ATGTGRAGATTGCACCTACCGG | not provided |
| 61726467 | DES | NM_001927.3(DES):c.1237G>A (p.Glu413Lys) | GGGAGAGRAGAGCCGGTGAGGG, AGGGAGAGRAGAGCCGGTGAGG | not provided |
| 62635763 | DES | NM_001927.3(DES):c.1255C>T (p.Pro419Ser) | CCCTTTTAGGATCAATCTCYCCA, CCTTTTAGGATCAATCTCYCCAT | Myofibrillar myopathy 1, not provided |
| 62636495 | DES | NM_001927.3(DES):c.38C>T (p.Ser13Phe) | CCAGCCAGCCGTGTCCTYCTAC, CCAGCGCGTGTCCTYCTACCGCC | Dilated cardiomyopathy 1I, Myofibrillar myopathy 1, not provided |
| 397517255 | DFNB31 | NM_015404.3(DFNB31):c.1267C>T (p.Arg423Ter) | CCTGGGAACCAGACAYGAGTG C | Usher syndrome, type 2D |
| 779760634 | DFNB31 | NM_015404.3(DFNB31):c.1417-1G>A | CCTCAGAGAGGAGTGAGAAYTG G | Deafness, autosomal recessive 31 |
| 137852839 | DFNB31 | NM_015404.3(DFNB31):c.2332C>T (p.Arg778Ter) | CCAGCGCCCAGGCYGAGGAAG G | Deafness, autosomal recessive 31 |
| 398123008 | DGKE | NM_003647.2(DGKE):c.127C>T (p.Gln43Ter) | CCTTCTGGTGTAGCCTCYAGCGG | Nephrotic syndrome, type 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893631 | DGUOK | NM_080916.2(DGUOK):c.425G>A (p.Arg142Lys) | AGARGTCTGTACAGTGACAGG | Mitochondrial DNA-depletion syndrome 3, hepatocerebral |
| 121909764 | DHCR7 | NM_001360.2(DHCR7):c.730G>A (p.Gly244Arg) | GGCGCCCCRGGATCGTCGCCTGG | Smith-Lemli-Opitz syndrome |
| 80338857 | DHCR7 | NM_001360.2(DHCR7):c.725G>A (p.Arg242His) | GGCRCCCCGGATCGTCGCCTGG | Smith-Lemli-Opitz syndrome |
| 398123607 | DHCR7 | NM_001360.2(DHCR7):c.841G>A (p. Val281Met) | TCTACRTGATTGACTTCTTCTGG | Smith-Lemli-Opitz syndrome, not provided |
| 80338853 | DHCR7 | NM_001360.2(DHCR7):c.278C>T (p.Thr93Met) | CCAAGACTCCACCTATAAYGAGG | Smith-Lemli-Opitz syndrome, not provided |
| 104886035 | DHCR7 | NM_001360.2(DHCR7):c.151C>T (p.Pro51Ser) | CCTACTGCTGTTCGCYCYCCTTCA | Smith-Lemli-Opitz syndrome, not provided |
| 267606766 | DHODH | NM_001361.4(DHODH):c.454G>A (p.Gly152Arg) | CAGTCACRGGCTTTCAGTGGTGG | Miller syndrome |
| 201230446 | DHODH | NM_001361.4(DHODH):c.403C>T (p.Arg135Cys) | CCCTAGACCCAGAGTCTTCYGCC, CCTAGACCCAGAGTCTTCYGCCT | Miller syndrome |
| 199422247 | DKC1 | NM_001363.4(DKC1):c.911G>A (p.Ser304Asn) | AAGACARTGCAGTAAGTTCCGGG, AAAGACARTGCAGTAAGTTCCGG | Dyskeratosis congenita X-linked |
| 121912289 | DKC1 | NM_001363.4(DKC1):c.1226C>T (p.Pro409Leu) | CCCACAGAGCACACYTGCCAC, CCACAGACAGCACACYTGCCACC | Dyskeratosis congenita X-linked |
| 121964992 | DLD | NM_000108.4(DLD):c.1123G>A (p.Glu375Lys) | TGTGTTRAAGGAATGGCTGGTGG | Maple syrup urine disease, type 3, not provided |
| 796065346 | DLL4 | NM_019074.3(DLL4):c.1169G>A (p.Cys390Tyr) | GAARTCCCCCACCACTTCACCGG | Adams-Oliver syndrome, ADAMS-OLIVER SYNDROME 6 |
| 398122853 | DMD | NM_004006.2(DMD):c.9G>A (p. Trp3Ter) | GCTTTGRTGGGAAGAAGTAGAGG | Duchenne muscular dystrophy, Becker muscular dystrophy, Dilated cardiomyopathy 3B, not provided |
| 398123936 | DMD | NM_004006.2(DMD):c.336G>A (p.Trp112Ter) | TTTGRAATATAATCCTCCACTGG | Duchenne muscular dystrophy, Becker muscular dystrophy, Dilated cardiomyopathy 3B |
| 398123939 | DMD | NM_004006.2(DMD):c.343-1G>A | GAARGTCTATGCCAGAAAGGAG, GTGGAARGTCTATGCCAGAAAGG | Dilated cardiomyopathy 3B |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398124032 | DMD | NM_004006.2(DMD):c.649+1G>A | CCTGAAGRTTGGTAAATTTCTGG | Duchenne muscular dystrophy, Becker muscular dystrophy, Dilated cardiomyopathy 3B |
| 398124076 | DMD | NM_004006.2(DMD):c.8668G>A (p.Glu2890Lys) | AGCCCAGARGTAATTGAATGTGG | Dilated cardiomyopathy 3B |
| 398124096 | DMD | NM_004006.2(DMD):c.956-1G>A | ATAATARGGACGAACAGGGAGG | Duchenne muscular dystrophy, Becker muscular dystrophy, Dilated cardiomyopathy 3B |
| 794727499 | DMD | NM_004006.2(DMD):c.133C>T (p.Gln45Ter) | CCTCTTCAGTGACCTAYAGGATG | Duchenne muscular dystrophy, Becker muscular dystrophy |
| 128626233 | DMD | NM_004006.2(DMD):c.178C>T (p.Gln60Ter) | CCTCGAAGGCCTGACAGGGYAAA | Duchenne muscular dystrophy |
| 128626238 | DMD | NM_000109.3(DMD):c.700C>T (p.Gln234Ter) | CCAAGTTTTGCCTCAAYAAGTGA | Duchenne muscular dystrophy |
| 128626245 | DMD | NM_004006.2(DMD):c.3121C>T (p.Gln1041Ter) | CCAGCTGGTTGAGCATTGTYAAA | Duchenne muscular dystrophy, Dilated cardiomyopathy 3B |
| 398123865 | DMD | NM_004006.2(DMD):c.1615C>T (p.Arg539Ter) | CCAGGTATTGGGAGATYGATGGG | Duchenne muscular dystrophy, Becker muscular dystrophy, Dilated cardiomyopathy 3B |
| 398123903 | DMD | NM_004006.2(DMD):c.2650C>T (p.Gln884Ter) | CCGGCTATCAGATCTTYAACCTC | Duchenne muscular dystrophy, Becker muscular dystrophy, Dilated cardiomyopathy 3B |
| 398123912 | DMD | NM_004006.2(DMD):c.2866C>T (p.Gln956Ter) | CCATCAGGACATGGGTCYAGCAG | Dilated cardiomyopathy 3B |
| 398123954 | DMD | NM_004006.2(DMD):c.4405C>T (p.Gln1469Ter) | CCAGCCAATTTTGAGYAGCGTCT | Dilated cardiomyopathy 3B |
| 398123990 | DMD | NM_004006.2(DMD):c.5353C>T (p.Gln1785Ter) | CCTTTGAAGGAATTGGAGYAGTT | Dilated cardiomyopathy 3B |
| 398123999 | DMD | NM_004006.2(DMD):c.583C>T (p.Arg195Ter) | CCAGCAGTCAGCCACCAAYGAC | Duchenne muscular dystrophy, Becker muscular dystrophy, Dilated cardiomyopathy 3B |
| 398124058 | DMD | NM_004006.2(DMD):c.7894C>T (p.Gln2632Ter) | CCAAAGACCTCCGCYAGTGGCAG | Duchenne muscular dystrophy, Becker muscular dystrophy, Dilated cardiomyopathy 3B |
| 398124099 | DMD | NM_004006.2(DMD):c.961C>T | CCTTTGTGACCTTTGGYAAGTCA | Dilated cardiomyopathy 3B |
| 368260932 | DNAH1 | NM_001277115.1(DNAH1)-5831C>T | CCAATTTGTACATCYGAACTGGA | Ciliary dyskinesia, primary, 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 567050969 | DNAH8 | 1):c.8698C>T (p.Arg2900Ter) | CCACGCTTTTGTGYGACATCCA | Kartagener syndrome, not provided |
| 730882139 | DNAJB2 | NM_001206927.1(DNAH8): c.2419C>T (p.Arg807Ter) | GACAGRTAGTGGAGTGGTGAG G | Charcot-Marie-Tooth disease, Spinal muscular atrophy, distal, autosomal recessive, 5 |
| 398122405 | DNAJC6 | NM_001039550.1(DNAJB2): c.-229+1G>A | CCCCACTCCTCCTCCYAGAACCG, CCCACTCCTCCTCCYAGAACCGA | Parkinson disease 19, juvenile-onset |
| 121909089 | DNM2 | NM_001256865.1(DNAJC6): c.2200C>T (p.Gln734Ter) | CGAGCRGTTCCCATTTGAGCTGG | Myopathy, centronuclear, 1, Myopathy, centronuclear |
| 796065342 | DNMT3A | NM_001005360.2(DNM2): c.1106G>A (p.Arg369Gln) | CCAAGGCCGTGGAGTGYAGAA C | Early T cell progenitor acute lymphoblastic leukemia |
| 121908943 | DNMT3B | NM_175629.2(DNMT3A):c. 1204C>T (p.Gln402Ter) | CGTCRCTTCTGAAGTGTGTGAGG | Centromeric instability of chromosomes 1, 9 and 16 and immunodeficiency |
| 547940069 | DNMT3B | NM_006892.3(DNMT3B):c. 1807G>A (p.Ala603Thr) | TCCRGTACCCCCAGATCTTTGG | Centromeric instability of chromosomes 1, 9 and 16 and immunodeficiency |
| 780318765 | DOCK2 | NM_175850.2(DNMT3B):c. 2397-11G>A | CCCTGAGGCTGAGCTCYGGAAAG, CCTGAGGCTGAGCTCYGGAAAGC | IMMUNODEFICIENCY 40 |
| 587777484 | DOCK7 | NM_004946.2(DOCK2):c.3 310C>T (p.Arg1104Trp) | CCACTCRAGCCTTTATCTGAGGG, GCCACTCRAGCCTTTATCTGAGG | Epileptic encephalopathy, early infantile, 23 |
| 397515322 | DPAGT1 | NM_033407.3(DOCK7):c.3 616C>T (p.Arg1206Ter) | TGARCAGCGGCACACGGGTCCGG, AGATGTGARCAGCGGCACACGG G | Congenital disorder of glycosylation type 1J |
| 397515640 | DSG1 | NM_001382.3(DPAGT1):c. 161+5G>A | CCTTCAAGATTATAAGAYAAGAA | Keratosis palmoplantaris striata 1 |
| 751012696 | DSG2 | NM_001942.3(DSG1):c.601 C>T (p.Gln201Ter) | GTGTTCRATGCAGATGAAATAGG | Cardiomyopathy |
| 1219913008 | DSG2 | NM_001943.3(DSG2):c.889 G>A (p.Asp297Asn) | TAGTGCRGCAAAAGCGCGCCTGG | Arrhythmogenic right ventricular cardiomyopathy, type 10, Cardiomyopathy |
| 1219913013 | DSG2 | NM_001943.3(DSG2):c.137 G>A (p.Arg46Gln) | GCCCCCRTGGCTCTTCGGAGGG, CGCCCCRTGGCTCTTCGGGAGG | Arrhythmogenic right ventricular cardiomyopathy, type 10, Arrhythmogenic right ventricular cardiomyopathy, Catecholaminergic polymorphic ventricular tachycardia, |
| | DSG2 | NM_001943.3(DSG2):c.166 G>A (p. Val56Met) | | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 201564919 | DSG2 | NM_001943.3(DSG2):c.191 2G>A (p.Gly63Arg) | CATTGCRGAAAGGGCGCCAAAG G | Dilated cardiomyopathy 1BB, Primary familial hypertrophic cardiomyopathy, Cardiomyopathy, not specified |
| 794728083 | DSG2 | NM_001943.3(DSG2):c.769 C>T (p.Gln257Ter) | CCTGTAAAACAAGCTYAAGTTCA | Arrhythmogenic right ventricular cardiomyopathy, Cardiomyopathy, not specified |
| 121912998 | DSP | NM_004415.2(DSP):c.88G>A (p.Val30Met) | GAGRTGACCAGCGGCGGCGGGG G, CGAGRTGACCAGCGGCGGCGGGG G, ACGAGRTGACCAGCGCGGCGGG G, TACGAGRTGACCAGCGCGGCGGG | Cardiomyopathy |
| 121912999 | DSP | NM_004415.2(DSP):c.8501 G>A (p.Arg2834His) | CTCRCTCCGGATCTCGCTCCGGG, TCTCRCTCCGGATCTCGCTCCGG | Arrhythmogenic right ventricular cardiomyopathy, type 8 |
| 397516943 | DSP | NM_004415.2(DSP):c.478C>T (p.Arg160Ter) | CCATCAGTGTCCCTYGAGTCCGC | Arrhythmogenic right ventricular cardiomyopathy, type 8, not provided |
| 767643821 | DSP | NM_004415.2(DSP):c.3805 C>T (p.Arg1269Ter) | CCACTGAGCAGCGAAGGYGAGC T | Arrhythmogenic right ventricular cardiomyopathy, type 8, not specified, not provided |
| 397509411 | DYNC1H1 | NM_001376.4(DYNC1H1): c.10151G>A (p.Arg3384Gln) | AATCRGGCTTCCCTGGCTTGCGG | not provided |
| 387906740 | DYNC1H1 | NM_001376.4(DYNC1H1): c.4552G>A (p.Glu1518Lys) | TGAARAGGATGCTCTCAGCTGGG, TTGAARAGATGCTCTCAGCTGG | Mental retardation, autosomal dominant 13 |
| 201479015 | DYNC2H1 | NM_001080463.1(DYNC2 H1):c.11747G>A (p.Gly3916Asp) | TAGRTGCCAAAGATGTACAATGG | Mental retardation, autosomal dominant 13 |
| 367643250 | DYRK1B | NM_004714.2(DYRK1B):c.304C>T (p.Arg102Cys) | CACTGCRCACGATGTAGTCATGG | Short-rib thoracic dysplasia 3 with or without polydactyly, not provided |
| 794727343 | DYSF | NM_003494.3(DYSF):c.19 56G>A (p.Trp652Ter) | CTGRGTAACGTGAAACCTGTGG | Abdominal obesity-metabolic syndrome 3 |
| 201869739 | DYSF | NM_003494.3(DYSF):c.93 7+1G>A | CCCRTGAGTTCTCACCACTTTGG | Miyoshi muscular dystrophy 1, Limb-girdle muscular dystrophy, type 2B, Myopathy, distal, with anterior tibial onset |
| | | | | Limb-girdle muscular dystrophy, type 2B, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 745891180 | DYSF | NM_003494.3(DYSF):c.50 57+5G>A | GTGTGTACRTGGATGGGGCTGG | Limb-girdle muscular dystrophy, type 2B |
| 398123763 | DYSF | NM_003494.3(DYSF):c.10 53+1G>A | GCCTRTGAGTACATTTCCCTGGG, CGCCTRTGAGTACATTTCCCTGG | Limb-girdle muscular dystrophy, type 2B, not provided |
| 398123794 | DYSF | NM_003494.3(DYSF):c.55 09G>A (p.Asp1837Asn) | TGAGCRACATTTATGTGAAAGGG, ATGAGCRACATTTATGTGAAAGG | Limb-girdle muscular dystrophy, type 2B, not provided |
| 794727636 | DYSF | NM_003494.3(DYSF):c.26 5C>T (p.Arg89Ter) | CCAAGGTCCCACTCYGAGAGGTC | Miyoshi muscular dystrophy 1, Limb-girdle muscular dystrophy, type 2B |
| 727503911 | DYSF | NM_003494.3(DYSF):c.38 32C>T (p.Gln1278Ter) | CCTCTTTTGAGCTCATCYAGAGA | Limb-girdle muscular dystrophy, type 2B, not provided |
| 398123773 | DYSF | NM_003494.3(DYSF):c.23 11C>T (p.Gln771Ter) | CCCTGCAGCTCTGGAGYAGGCGG, CCTGCAGCTCTGGAGYAGGCGGA | Limb-girdle muscular dystrophy, type 2B, not provided |
| 398123789 | DYSF | NM_003494.3(DYSF):c.47 56C>T (p.Arg1586Ter) | CCGTATCTACATTGTCYGAGCAT | Miyoshi muscular dystrophy 1, Limb-girdle muscular dystrophy, type 2B, not provided |
| 397514594 | EARS2 | NM_001083614.1(EARS2): c.500G>A (p.Cys167Tyr) | TCGGTRCAGGAACATGAGCCAGG | Combined oxidative phosphorylation deficiency 12 |
| 376103091 | EARS2 | NM_001083614.1(EARS2): c.322C>T (p.Arg108Trp) | CCCCRGCGGGGCTCTCATCAGG | Combined oxidative phosphorylation deficiency 12 |
| 104894792 | EBP | NM_006579.2(EBP):c.386 G>A (p.Trp129Ter) | TGTRGGGACACCACTCAGCCTGTGG | Chondrodysplasia punctata 2 X-linked dominant |
| 104894794 | EBP | NM_006579.2(EBP):c.587 G>A (p.Trp196Ter) | GCCCTGTRGCTGGTGCTGCCTGG | Chondrodysplasia punctata 2 X-linked dominant |
| 104894798 | EBP | NM_006579.2(EBP):c.87G >A (p.Trp29Ter) | CCCACCTGRCATATACTGGCTGG | Chondrodysplasia punctata 2 X-linked dominant |
| 104894799 | EBP | NM_006579.2(EBP):c.187C >T (p.Arg63Ter) | CCCATTGGGGACTTGGCGYGAC, CCATTGGGGACTTGGCGYGACT | Chondrodysplasia punctata 2 X-linked dominant |
| 587783613 | EBP | NM_006579.2(EBP):c.328C >T (p.Arg110Ter) | CCAAGGGAGACAGCYGATACATC | Chondrodysplasia punctata 2 X-linked dominant |
| 587776498 | ECHS1 | NM_004092.3(ECHS1):c.5 C>T (p.Ala2Val) | CCAGAGAGCCATGGYCGCCCTGC | Leigh disease, MITOCHONDRIAL SHORT-CHAIN ENOYL-COA HYDRATASE 1 DEFICIENCY |
| 121909114 | ECM1 | NM_004425.3(ECM1):c.10 36C>T (p.Gln346Ter) | CCAGCTGAGAGGAGTTCYAGC | Lipid proteinosis |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909115 | ECM1 | NM_004425.3(ECM1):c.15 7C>T (p.Arg53Ter) | CCCCTCCCACCCCTATCCYGAA, CCTCCCACCCCTATCCYGAAG, CCTCCCACCCCTATCCYGAAGC, CCCCACCCCTATCCYGAAGCTC | Lipid proteinosis |
| 397516677 | EDA | NM_001399.4(EDA):c.871 G>A (p.Gly291Arg) | CAGCRGGGAGCTGAGGTACTGG | Hypohidrotic X-linked ectodermal dysplasia |
| 727504537 | EDA | NM_001399.4(EDA):c.39 6+1G>A | CCAGRTGAGTCACCTAGTAGGGG, ACCAGRTGAGTCACCTAGTAGG, CACCAGRTGAGTCACCTAGTAGG | Hypohidrotic X-linked ectodermal dysplasia |
| 132630310 | EDA | NM_001399.4(EDA):c.67C >T (p.Gln23Ter) | CCGCGGGAGCGAGGGAGCYAGG G | Hypohidrotic X-linked ectodermal dysplasia |
| 132630315 | EDA | NM_001399.4(EDA):c.626 C>T (p.Pro209Leu) | CCAGGGATTCCTGGAATTCYAGG | Hypohidrotic X-linked ectodermal dysplasia, not specified |
| 727503007 | EDA | NM_001399.4(EDA):c.676 C>T (p.Gln226Ter) | CCAGTCCTCCTGGTCCTYAAGG | Hypohidrotic X-linked ectodermal dysplasia |
| 121908450 | EDAR | NM_022336.3(EDAR):c.26 6G>A (p.Arg89His) | AGGGRTCACAAAGACTGTGAGGG, CAGGRTCACAAAGACTGTGAGG | Autosomal recessive hypohidrotic ectodermal dysplasia syndrome |
| 121908453 | EDAR | NM_022336.3(EDAR):c.12 59G>A (p.Arg420Gln) | GATTGAGCRGCTGGATGCTGTGG | Autosomal dominant hypohidrotic ectodermal dysplasia |
| 121908452 | EDAR | NM_022336.3(EDAR):c.10 72C>T (p.Arg358Ter) | CCTCGAGAAGACTAGCYGAATGC | |
| 74315309 | EDARADD | NM_080738.3(EDARADD):c.424G>A (p.Glu142Lys) | CTATGACRAATTGTGCTTCCTGG | Autosomal recessive hypohidrotic ectodermal dysplasia syndrome, Ectodermal dysplasia 11b, hypohidrotic/hair/tooth type, autosomal recessive |
| 121434491 | EFEMP1 | NM_001039348.2(EFEMP1):c.1033C>T (p.Arg345Trp) | CCACAAATGAATGCYGGGAGGA T | Doyne honeycomb retinal dystrophy, Malattia leventinese |
| 193302866 | EFEMP2 | NM_016938.4(EFEMP2):c.800G>A (p.Cys267Tyr) | TTTCTCCTRCCACTGCCCACAGGG, TTTCTCCTRCCACTGCCCACAGG | Autosomal recessive cutis laxa type 1B |
| 119489102 | EFEMP2 | NM_016938.4(EFEMP2):c.835C>T (p.Arg279Cys) | CCAGCTGCTGGCCACAYGCCTCT | Autosomal recessive cutis laxa type IA, Autosomal recessive cutis laxa type 1B |
| 387906878 | EFTUD2 | NM_004247.3(EFTUD2):c.2770C>T (p.Gln924Ter) | CCGGCCCCTTGGAGCCAYAGCCAG | Growth and mental retardation, mandibulofacial dysostosis, microcephaly, and cleft palate |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894161 | EGR2 | NM_000399.3(EGR2):c.1075C>T (p.Arg359Trp) | CCGCTCTGACGAGCTGACAYGGC | Dejerine-Sottas disease, Charcot-Marie-Tooth disease, type 1D |
| 587777208 | EIF2AK4 | NM_001013703.3(EIF2AK4):c.3448C>T (p.Arg1150Ter) | CCGCCAAGTTAGATYGATTTCA | Familial pulmonary capillary hemangiomatosis |
| 104894427 | EIF2B2 | NM_014239.3(EIF2B2):c.547C>T (p.Arg183Ter) | CCTCAAAGAGGCTGCCYGAAAGA | Ovarioleukodystrophy |
| 113994033 | EIF2B4 | NM_001034116.1(EIF2B4):c.1070G>A (p.Arg357Gln) | GCGGTTTCRGGTGGTAGTGGTGG | Leukoencephalopathy with vanishing white matter |
| 113994037 | EIF2B4 | NM_001034116.1(EIF2B4):c.1191+1G>A | AGAGRTAAGTACAGAGGAAAAGG | Leukoencephalopathy with vanishing white matter |
| 113994027 | EIF2B4 | NM_001034116.1(EIF2B4):c.683C>T (p.Ala228Val) | CCAATGCCCGTGTATTGYCCTG | Leukoencephalopathy with vanishing white matter |
| 113994055 | EIF2B5 | NM_003907.2(EIF2B5):c.583C>T (p.Arg195Cys) | CCCCCAGCCACCCAACTYGTTGC, CCCCAGCCACCCAACTYGTTGCC, CCCAGCCACCCAACTYGTTGCCA, CCAGCCACCCAACTYGTTGCCAC | Ovarioleukodystrophy |
| 119484086 | ELAC2 | NM_018127.6(ELAC2):c.2342G>A (p.Arg781His) | GGAGGAGCRCAGGGAGAAGCGGG | Prostate cancer, hereditary, 2 |
| 137854450 | ELANE | NM_001972.2(ELANE):c.377C>T (p.Ser126Leu) | CCGCCACAGCTCAACGGGTYGGC, CCACAGCTCAACGGGTYGGCCAC | Severe congenital neutropenia autosomal dominant |
| 727503035 | ELN | NM_000501.3(ELN):c.1918+1G>A | GTTTGRTGAGCACTGGGTGGAGG, CCAGTTTGRTGAGCACTGGGTGG | Supravalvar aortic stenosis |
| 137854452 | ELN | NM_000501.3(ELN):c.1324C>T (p.Gln442Ter) | CCTTGTAGCCGAAGCTYAGGCAG | Supravalvar aortic stenosis |
| 515726212 | EPB42 | NM_000119.2(EPB42):c.949C>T (p.Arg317Cys) | CCACCCRGGCAGGGATTCCCAGG | Spherocytosis type 5 |
| 267606785 | EPCAM | NM_002354.2(EPCAM):c.197G>A (p.Cys66Tyr) | TGCCAAATRTTTGGTGATGAAGG | Diarrhea 5, with tufting enteropathy, congenital |
| 116506614 | EPHA2 | NM_004431.3(EPHA2):c.2162G>A (p.Arg721Gln) | CCAGCTGCGATGCCCYGCAGCAT | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28933368 | ERBB2 | NM_001005862.2(ERBB2): c.2650G>A (p.Glu884Lys) | GTGGRAGCTGATGACTTTTGGGG, TGTGGRAGCTGATGACTTTTGGG, GTGTGGRAGCTGATGACTTTTGG | Glioma susceptibility 1 |
| 121913023 | ERCC2 | NM_000400.3(ERCC2):c.2 041G>A (p.Asp681Asn) | GCCRACAAGGTGCAGCTTCAGGG, TGCCRACAAGGTGCAGCTTCAGG | Cerebrooculofacioskeletal syndrome 2 |
| 41556519 | ERCC2 | NM_000400.3(ERCC2):c.2 047C>T (p.Arg683Trp) | CCTGCGCTTCTGCCCACAGYGGT | Xeroderma pigmentosum, group D |
| 121913017 | ERCC2 | NM_000400.3(ERCC2):c.2 176C>T (p.Gln726Ter) | CCTGCGGCAGATGGCAYAGCCCT | Xeroderma pigmentosum, group D |
| 121913021 | ERCC2 | NM_000400.3(ERCC2):c.1 972C>T (p.Arg658Cys) | CCTTCGATGCCATGYGCCACGCG | Photosensitive trichothiodystrophy |
| 121913024 | ERCC2 | NM_000400.3(ERCC2):c.1 846C>T (p.Arg616Trp) | CCAGTGCACCACTACGGGYGGGC | Cerebro-oculo-facio-skeletal syndrome, Xeroderma pigmentosum, group D, Cerebrooculofacioskeletal syndrome 2 |
| 121913026 | ERCC2 | NM_000400.3(ERCC2):c.2 164C>T (p.Arg722Trp) | CCAAGTACTTCCTGYGGCAGATG | Photosensitive trichothiodystrophy |
| 121913047 | ERCC3 | NM_000122.1(ERCC3):c.1 273C>T (p.Arg425Ter) | CCTGGGAGGCCGAGYGAGTCATG | Xeroderma pigmentosum, complementation group b |
| 121917904 | ERCC6 | NM_000124.3(ERCC6):c.2 047C>T (p.Arg683Ter) | CCGATGCAAAATAACCTCYGAGA | Cerebro-oculo-facio-skeletal syndrome |
| 121434325 | ERCC8 | NM_000082.3(ERCC8):c.4 79C>T (p.Ala160Val) | CCAAGCACTGTTTGTGTAGYAGGT | Cockayne syndrome type A, not provided |
| 587777006 | ERF | NM_006494.3(ERF):c.547C >T (p.Arg183Ter) | TGAGCCTCRGCCCCAGGCGGCGGG | Craniosynostosis 4 |
| 587777010 | ERF | NM_006494.3(ERF):c.1270 C>T (p.Gln424Ter) | TCTRTGGTGCGGGGGCGGTGGG, ATCTRTGGTGCGGGGGCCGTGG, TTGATCTRTGGTGCGGGGGCGG | Craniosynostosis 4 |
| 56025238 | ERMAP | NM_001017922.1(ERMAP): c.169G>A (p.Gly57Arg) | GCCCRGACGGTACCCAAGGAG, G, CTGGCCCRGACGGTACCCAAGG | |
| 80359865 | ESCO2 | NM_001017420.2(ESCO2): c.1354-18G>A | TCTTRGTTTTTAAAATCATTAGG | Roberts-SC phocomelia syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80359850 | ESCO2 | NM_001017420.2(ESCO2): c.604C>T (p.Gln202Ter) | CCAAAAATAAAACCAYAAGTT A | Roberts-SC phocomelia syndrome |
| 121908136 | ESPN | NM_031475.2(ESPN):c.232 1G>A (p.Arg774Gln) | GGCRGAAGGTGGGTGGGCGG, AGGGCRGAAGGTGGGTGGGGCGG, GAGGCRGAAGGTGGGTGGGGCG, GCAGAGGCRGAAGGTGGGTGGG G | Deafness, without vestibular involvement, autosomal dominant |
| 104893956 | ESR1 | NM_001122742.1(ESR1):c. 469C>T (p.Arg157Ter) | CCAAATTCAGATAATYGACCCA | Estrogen resistance |
| 119458971 | ETFA | NM_000126.3(ETFA):c.346 G>A (p.Gly116Arg) | CTGCCTTCRGAAAGTGAGAAGG | Glutaric acidemia IIA |
| 104894677 | ETFB | NM_001985.2(ETFB):c.491 G>A (p.Arg164Gln) | GTGAGCRGAGATCGATGGGG, AGTGAGCRGAGATCGATGGG G | Glutaric acidemia IIB |
| 796051960 | ETFDH | NM_004453.3(ETFDH):c.1 809G>A (p.Trp603Ter) | AACTGRGTGTACCTGAAGGTGG, ATTAACTGRGTGGTACCTGAAGG | not provided |
| 724159946 | ETV6 | NM_001987.4(ETV6):c.110 6G>A (p.Arg369Gln) | TTCCRGATAGTGGATCCCAACGG | Hematologic neoplasm, Thrombocytopenia, 5 |
| 724159947 | ETV6 | NM_001987.4(ETV6):c.641 C>T (p.Pro214Leu) | CCGCGCCTCTCCCYGGCTGAGA | Hematologic neoplasm, Thrombocytopenia, 5 |
| 121909199 | EYA1 | NM_000503.5(EYA1):c.12 76G>A (p.Gly426Ser) | GTGTACGGRGCGGTGTGGACTGG | Retinitis pigmentosa |
| 527236064 | EYS | NM_001142800.1(EYS):c.7 793G>A (p.Gly2598Asp) | CCTGAGGRCCACCCAAATGCTGG | Retinitis pigmentosa |
| 794727631 | EYS | NM_001142800.1(EYS):c.4 90C>T (p.Arg164Ter) | CCTTGTCCACTGGGACTTYGACT | Retinitis pigmentosa 25 |
| 587783625 | EZH2 | NM_004456.4(EZH2):c.187 6G>A (p.Val626Met) | CATCTGACRTGGCAGGCTGGGGG | Weaver syndrome |
| 61753266 | F10 | NM_000504.3(F10):c.424G >A (p.Glu142Lys) | CCACRAGGAACAGAGACTCTGTGG | Factor X deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913071 | F13A1 | NM_000129.3(F13A1):c.782G>A (p.Arg261His) | CAGCCRTGTGGGTCTGCAATGG | Factor xiii, a subunit, deficiency of |
| 121913065 | F13A1 | NM_000129.3(F13A1):c.514C>T (p.Arg172Ter) | CCCTATGGCGTACTTYGAACCAG, CCTATGGCGTACTTYGAACCAGT | Factor xiii, a subunit, deficiency of |
| 267606787 | F13A1 | NM_000129.3(F13A1):c.2110C>T (p.Arg704Trp) | CCCTGGGTCTCTGGGCATYGGAA, CCTGGGTCTCTGGGCATYGGAAG | Factor xiii, a subunit, deficiency of |
| 267606789 | F13A1 | NM_000129.3(F13A1):c.1984C>T (p.Arg662Ter) | CCTTTAAAGAAAACCCTGYGAAA | Factor xiii, a subunit, deficiency of |
| 121918482 | F2 | NM_000506.3(F2):c.1292G>A (p.Arg431His) | TCCCRCCACCAGGTACAGAACTGG | |
| 121918483 | F2 | NM_000506.3(F2):c.1027G>A (p.Glu343Lys) | GTTCRAGAGAAGTCGCTGGAGG, TCTGTTCRAGAAGAAGTCGCTGG | Hereditary factor II deficiency disease |
| 121918484 | F2 | NM_000506.3(F2):c.1054G>A (p.Glu352Lys) | CAAAACCRAAAGAGAGCTCCTGG | Hereditary factor II deficiency disease |
| 386834228 | F5 | NM_000130.4(F5):c.5668G>A (p.Glu1890Lys) | TTGGARAAAACCAGAGAGCAGG, GTTGGARAAAACCAGAGAGCAGG | not provided |
| 36209567 | F7 | NM_000131.4(F7):c.1061C>T (p.Ala354Val) | CCGTGGCGCCACGGYCCTGAGC | Factor VII deficiency |
| 137852373 | F8 | NM_000132.3(F8):c.5167G>A (p.Glu1723Lys) | GTGRAGAGGCTCTCGGGATTATGG | Hereditary factor VIII deficiency disease |
| 137852466 | F8 | NM_000132.3(F8):c.6545G>A (p.Arg2182His) | ACTCTTCRCATGGAGTTGATGGG, CACTCTTCRCATGGAGTTGATGG | Hereditary factor VIII deficiency disease |
| 28933681 | F8 | NM_000132.3(F8):c.5710G>A (p.Glu1904Lys) | TCTTTGATRAGACCAAAAGCTGG | Hereditary factor VIII deficiency disease |
| 137852357 | F8 | NM_000132.3(F8):c.6496C>T (p.Arg2166Ter) | CCCTCCAATTATTGCTYGATACA, CCTCCAATTATTGCTYGATACAT | Hereditary factor VIII deficiency disease |
| 137852364 | F8 | NM_000132.3(F8):c.1171C>T (p.Arg391Cys) | CCTTCCTTTATCCAAATTYGCTC, CCTTTATCCAAATTYGCTCAGTT | Hereditary factor VIII deficiency disease |
| 137852368 | F8 | NM_000132.3(F8):c.103C>T (p.Arg35Ter) | CCAGRAGGAACCCCAACTAYGAAT | Hereditary factor VIII deficiency disease |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852393 | F8 | NM_000132.3(F8):c.493C>T (p.Pro165Ser) | CCTGAAAGAGAATGGTYCAATGG | Hereditary factor VIII deficiency disease |
| 137852401 | F8 | NM_000132.3(F8):c.881C>T (p.Thr294Ile) | CCTCGAAGGTCACAYATTTCTTG | Hereditary factor VIII deficiency disease |
| 137852416 | F8 | NM_000132.3(F8):c.1636C>T (p.Arg546Trp) | CCAACTAAATCAGATCCTYGGTG | Hereditary factor VIII deficiency disease |
| 137852428 | F8 | NM_000132.3(F8):c.1834C>T (p.Arg612Cys) | CCTCACAGAGAATATACAAYGCT | Hereditary factor VIII deficiency disease |
| 137852435 | F8 | NM_000132.3(F8):c.2149C>T (p.Arg717Trp) | CCACAACTCAGACTTTYGGAACA | Hereditary factor VIII deficiency disease |
| 137852445 | F8 | NM_000132.3(F8):c.5422C>T (p.Leu1808Phe) | CCTTCTATTCTAGCYTTATTTCT | Hereditary factor VIII deficiency disease |
| 137852453 | F8 | NM_000132.3(F8):c.6046C>T (p.Arg2016Trp) | CCAAAGCTGGAATTTGGYGGGTG | Hereditary factor VIII deficiency disease |
| 137852456 | F8 | NM_000132.3(F8):c.6263C>T (p.Ser2088Phe) | CCAAGGAGCCCTTTYTTGGATC | Hereditary factor VIII deficiency disease |
| 137852463 | F8 | NM_000132.3(F8):c.6518C>T (p.Thr2173Ile) | CCGTTTGCACCCAAYTCATTATA | Hereditary factor VIII deficiency disease |
| 137852464 | F8 | NM_000132.3(F8):c.6532C>T (p.Arg2178Cys) | CCCAACTCATTATAGCATTYGCA, CCAACTCATTATAGCATTYGCAG | Hereditary factor VIII deficiency disease |
| 137852473 | F8 | NM_000132.3(F8):c.6967C>T (p.Arg2323Cys) | CCCACCGTTACTGACTYGCTACC, CCACCGTTACTGACTYGCTACCT | Hereditary factor VIII deficiency disease |
| 137852257 | F9 | NM_000133.3(F9):c.1069G>A (p.Gly357Arg) | TGGRGAAGAGTCTTCCACAAAGG | Hereditary factor IX deficiency disease |
| 137852267 | F9 | NM_000133.3(F9):c.1324G>A (p.Gly442Arg) | CAAATATRGAATATATACCAAGG | Hereditary factor IX deficiency disease |
| 137852275 | F9 | NM_000133.3(F9):c.1070G>A (p.Gly357Glu) | GGGRAAGAGTCTTCCACAAAGGG, TGGGRAAGAGTCTTCCACAAAGG | Hereditary factor IX deficiency disease |
| 137852272 | F9 | NM_000133.3(F9):c.484C>T (p.Arg162Ter) | CCTGTACTGAGGGATATYGACTT | Hereditary factor IX deficiency disease |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907040 | FA2H | NM_024306.4(FA2H):c.460 C>T (p.Arg154Cys) | CCGGTGACCAGGCCCATCYGCCT | Spastic paraplegia 35 |
| 80338901 | FAH | NM_000137.2(FAH):c.1062 +5G>A | TGARTATCTGGCTGCACTGAGGG, GTGARTATCTGGCTGCACTGAGG | Tyrosinemia type I, not provided |
| 587777011 | FAM111A | NM_001142519.1(FAM111A):c.1706G>A (p.Arg569His) | ACTCRTAGTATCATTGAGTTTGG | Kenny-Caffey syndrome type 2 |
| 587777238 | FAM111B | NM_198947.3(FAM111B):c.1883G>A (p.Ser628Asn) | GAARTTTCCTATCAGAGTTTGG, CCAAAGAARTTCCTATCAGAGG | Poikiloderma, hereditary fibrosing, with tendon contractures, myopathy, and pulmonary fibrosis |
| 137852737 | FAM134B | NM_001034850.2(FAM134B):c.433C>T (p.Gln145Ter) | CCCTGTTGCAGGTGCAYAGTTGT, CCTGTTGCAGGTGCAYAGTTGTG | Hereditary sensory and autonomic neuropathy type IIB, Hereditary sensory and autonomic neuropathy type IIA |
| 796051850 | FAM20C | NM_020223.3(FAM20C):c.1645C>T (p.Arg549Trp) | CCTGGAGGCCCTGGACCGGYGGC | Raine syndrome |
| 137854435 | FAM83H | NM_198488.3(FAM83H):c.973C>T (p.Arg325Ter) | CCCCTTCTCCTTCCCTAAAYGAG, CCCTTCTCCTTCCCTAAAYGAGC, CCTTCTCCTTCCCTAAAYGAGCG | Amelogenesis imperfecta, hypocalcification type |
| 137854440 | FAM83H | NM_198488.3(FAM83H):c.2029C>T (p.Gln677Ter) | CCTGAACCCCTGGTCYAGCGCA | Amelogenesis imperfecta, hypocalcification type |
| 387907056 | FAM83H | NM_198488.3(FAM83H):c.1366C>T (p.Gln456Ter) | CCGTGACCAGCTCTACCAGYAGC | Amelogenesis imperfecta, hypocalcification type |
| 730881731 | FANCC | NM_000136.2(FANCC):c.319C>T (p.Gln107Ter) | CCACAGAATTCTGGAYAATCAAA | Hereditary cancer-predisposing syndrome |
| 121434506 | FANCE | NM_021922.2(FANCE):c.421C>T (p.Arg141Ter) | CCCTGGGGAATTGCTGYGAAGG, CCTGGGGGAATTGCTGYGAAGGG | Fanconi anemia, complementation group E |
| 121918163 | FANCI | NM_001113378.1(FANCI):c.3854G>A (p.Arg1285Gln) | TCACRAGACTTCAAGATCAAAGG | Fanconi anemia, complementation group I |
| 121913077 | FAS | NM_000043.4(FAS):c.817C>T (p.Gln273Ter) | CCAAGACACAGCAGAAYAGAAAG | Autoimmune lymphoproliferative syndrome, type 1a |
| 398122955 | FAT4 | NM_024582.4(FAT4):c.7123G>A (p.Glu2375Lys) | ATTCCTRAGGATGCACCAACTGG | Van Maldergem syndrome 2, Hennekam lymphangiectasia-lymphedema syndrome 2 |
| 80338765 | FBLN5 | NM_006329.3(FBLN5):c.604G>A (p.Gly202Arg) | GAGGATRGAAGGTCTTGCCAAGG | Autosomal recessive cutis laxa type IA |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28939073 | FBLN5 | NM_006329.3(FBLN5):c.1051C>T (p.Arg351Trp) | CCCTTTACCATCTTGTACYGGGA, CCTTTACCATCTTGTACYGGGAC | Age-related macular degeneration 3 |
| 193922236 | FBN1 | NM_000138.4(FBN1):c.7806G>A (p.Trp2602Ter) | TACCAGTGRAACCAGTGTGTTGG | Thoracic aortic aneurysms and aortic dissections, Marfan syndrome |
| 794728166 | FBN1 | NM_000138.4(FBN1):c.1421G>A (p.Cys474Tyr) | ACCGGTRTGAGTGCAACAAAGGG, TACCGGTRTGAGTGCAACAAAGG | Thoracic aortic aneurysms and aortic dissections |
| 794728170 | FBN1 | NM_000138.4(FBN1):c.1583G>A (p.Cys528Tyr) | AGAATRCCGAGGTATGGTCCTGG | Thoracic aortic aneurysms and aortic dissections |
| 794728237 | FBN1 | NM_000138.4(FBN1):c.5699G>A (p.Cys1900Tyr) | CCTRTGGGAATGGAACTTGCCGG | Thoracic aortic aneurysms and aortic dissections |
| 794728240 | FBN1 | NM_000138.4(FBN1):c.5801G>A (p.Cys1934Tyr) | ATGAATRTGCAAGTGGAAATGGG, GATGAATRTGCAAGTGGAAATGG | Thoracic aortic aneurysms and aortic dissections |
| 794728257 | FBN1 | NM_000138.4(FBN1):c.6871G>A (p.Asp2291Asn) | TGTARGTAAGAGGATCCCTGTGG | Thoracic aortic aneurysms and aortic dissections |
| 794728266 | FBN1 | NM_000138.4(FBN1):c.7205-1G>A | TACARATATCGATGAATGCAAGG | Thoracic aortic aneurysms and aortic dissections |
| 397515757 | FBN1 | NM_000138.4(FBN1):c.1468+5G>A | GTACRTGATCCATCCTAGGTTGG, ATTGGTACRTGATCCATCCTAGG | Thoracic aortic aneurysms and aortic dissections, Marfan syndrome |
| 397515804 | FBN1 | NM_000138.4(FBN1):c.4259G>A (p.Cys1420Tyr) | CAGTRCCTCAATGCACCAGGAGG, GGCCAGTRCCTCAATGCACCAGG | Thoracic aortic aneurysms and aortic dissections, Marfan syndrome |
| 397515859 | FBN1 | NM_000138.4(FBN1):c.7955G>A (p.Cys2652Tyr) | CAATGAATRTGGCTCTGCGCAGG | Thoracic aortic aneurysms and aortic dissections, Marfan syndrome |
| 775417975 | FBN1 | NM_000138.4(FBN1):c.3513C>A (p.Cys1171Ter) | GGTTCACRCAACGGCCATTGGGG, AGGTTCACRCAACGGCCATTGGG | Thoracic aortic aneurysms and aortic dissections |
| 794728335 | FBN1 | NM_000138.4(FBN1):c.6425G>A (p.Cys2142Tyr) | GGACAGTRCATCAATACAGATGG | Thoracic aortic aneurysms and aortic dissections |
| 548296552 | FBN1 | NM_000138.4(FBN1):c.2926C>T (p.Arg976Cys) | ATGCRGTGCGGCCAGCAATAGG | Thoracic aortic aneurysms and aortic dissections |
| 137854475 | FBN1 | NM_000138.4(FBN1):c.3509G>A (p.Arg1170His) | GCCRTTGCTGAACCTCATAGGG, GGCCRTTGCTGAACCTCATAGG | Thoracic aortic aneurysms and aortic dissections, Marfan syndrome, Marfanoid habitus, not specified, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137854482 | FBN1 | NM_000138.4(FBN1):c.3386G>A (p.Cys1129Tyr) | GGTGTTTRCCATAACACAGAGGG, TGGTGTTTRCCATAACACAGAGG | Marfan syndrome |
| 137854483 | FBN1 | NM_000138.4(FBN1):c.3662G>A (p.Cys1221Tyr) | TATGAATRTAGCTGTCAGCCGGG, CTATGAATRTAGCTGTCAGCCGG | Marfan syndrome |
| 137854484 | FBN1 | NM_000138.4(FBN1):c.3257G>A (p.Cys1086Tyr) | CCAGTRTGTGAACACCCCTGGGG, GCCAGTRTGTGAACACCCCTGGG, GGCCAGTRTGTGAACACCCCTGG | |
| 369294972 | FBN1 | NM_000138.4(FBN1):c.7660C>T (p.Arg2554Trp) | GAATCCCCRCTGGCATTCACAGG | Thoracic aortic aneurysms and aortic dissections, Marfan syndrome, incomplete |
| 113871094 | FBN1 | NM_000138.4(FBN1):c.4786C>T (p.Arg1596Ter) | CCTGGAGGGAAGGTTTCYGACC | Thoracic aortic aneurysms and aortic dissections, Marfan syndrome |
| 794728262 | FBN1 | NM_000138.4(FBN1):c.7003C>T (p.Arg2335Trp) | CCCTTCCAGACAATYGGGAAGGG | Thoracic aortic aneurysms and aortic dissections |
| 730880099 | FBN1 | NM_000138.4(FBN1):c.1633C>T (p.Arg545Cys) | CCGGATCTGCAATAATGGAYGCT | Marfan syndrome |
| 794728195 | FBN1 | NM_000138.4(FBN1):c.2645C>T (p.Ala882Val) | CCTCCCTCGTGCTGYGTGGGGA | Thoracic aortic aneurysms and aortic dissections |
| 794728196 | FBN1 | NM_000138.4(FBN1):c.2671C>T (p.Gln891Ter) | CCCGTGCACCCTATGCYAAGTTG, CCGTGCACCCTATGCYAAGTTGG | Thoracic aortic aneurysms and aortic dissections |
| 794728231 | FBN1 | NM_000138.4(FBN1):c.4888C>T (p.Gln1630Ter) | CCTTTGGGAGTTTCYAGTGCCGC | Thoracic aortic aneurysms and aortic dissections |
| 397514558 | FBN1 | NM_000138.4(FBN1):c.2920C>T (p.Arg974Cys) | CCCTGCCTATTGCTGGCYGCCAC, CCTGCCTATTGCTGGCYGCCACC | Marfan syndrome, Ectopia lentis, isolated, autosomal dominant |
| 794728283 | FBN1 | NM_000138.4(FBN1):c.8038C>T (p.Arg2680Cys) | CCACCTGGTTACTTCYGCATAGG | Thoracic aortic aneurysms and aortic dissections |
| 140630 | FBN1 | NM_000138.4(FBN1):c.4930C>T (p.Arg1644Ter) | CCTGAATGAAGATACAYGAGTGT | Thoracic aortic aneurysms and aortic dissections |
| 113001196 | FBN1 | NM_000138.4(FBN1):c.6658C>T (p.Arg2220Ter) | CCTCTGCTCTGTGCCTTCYGATG | Thoracic aortic aneurysms and aortic dissections, Marfan syndrome |
| 112645512 | FBN1 | NM_000138.4(FBN1):c.1285C>T (p.Arg429Ter) | CCTCAAATTCCGGTCCCTYGACC | Marfan syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 25403 | FBN1 | NM_000138.4(FBN1):c.184 C>T (p.Arg62Cys) | CCCAATGTCTGTGGATCAYGTTA, CCAATGTCTGTGGATCAYGTTAT | Marfan syndrome |
| 137852826 | FBN2 | NM_001999.3(FBN2):c.117 1G>A (p.Glu391Lys) | TGTRAGCCTGGCCGCTGCTGGGG, CTGTRAGCCTGGCCGCTGCTGG, GCTGTRAGCCTGGCCGCTGCTGG | Congenital contractural arachnodactyly |
| 121918188 | FBP1 | NM_001127628.1(FBP1):c.490G>A (p.Gly164Ser) | GCAGCCRGCTACGACTGTATGG | Fructose-biphosphatase deficiency |
| 398123061 | FBXL4 | NM_012160.4(FBXL4):c.1444C>T (p.Arg482Trp) | CCAAGTGTAAAAAACTCYGGACC | Mitochondrial encephalomyopathy, Mitochondrial DNA depletion syndrome 13 (encephalomyopathic type), Global developmental delay |
| 121918305 | FBXO7 | NM_012179.3(FBXO7):c.65C>T (p.Thr22Met) | CCCGAGACGGAGCCGAYGCTGG, CCGAGACGGAGCCGAYGCTGGG | Parkinson disease 15 |
| 267606804 | FECH | NM_001012515.2(FECH):c.1243C>T (p.Pro415Ser) | CCGCTCTGTGTCAATYCTGTCTG | Erythropoietic protoporphyria |
| 121918292 | FERMT1 | NM_017671.4(FERMT1):c.787C>T (p.Gln263Ter) | CCTTATGGAACAAGGCATCYAAG | Kindler syndrome |
| 121918296 | FERMT3 | NM_178443.2(FERMT3):c.48G>A (p.Trp16Ter) | ATGRGAGCTGCGGGTGTTTGTGG | LEUKOCYTE ADHESION DEFICIENCY, TYPE III |
| 121918298 | FERMT3 | NM_178443.2(FERMT3):c.687G>A (p.Trp229Ter) | CCAGGTGRCTGGACTCGTCGCGG | LEUKOCYTE ADHESION DEFICIENCY, TYPE III |
| 121918295 | FERMT3 | NM_178443.2(FERMT3):c.1537C>T (p.Arg513Ter) | CCCCCCGTTTCCAGYGAAAGTTC | LEUKOCYTE ADHESION DEFICIENCY, TYPE III |
| 121918297 | FERMT3 | NM_178443.2(FERMT3):c.1729C>T (p.Arg577Ter) | CCTGGGCATCGCCAACAACYGAC | LEUKOCYTE ADHESION DEFICIENCY, TYPE III |
| 121909607 | FGA | NM_000508.3(FGA):c.104G>A (p.Arg35His) | CGTGCRTGGCCCAAGGGTTGTGG | Dysfibrinogenemia |
| 606231223 | FGB | NM_005141.4(FGB):c.958+13C>T | CCAGGTAACGAACAGGYATGCA A | Afibrinogenemia, congenital |
| 28935498 | FGD1 | NM_004463.2(FGD1):c.935 C>T (p.Pro312Leu) | CCCAGCCAGCCTCTGCCYTGG, CCAGCCACAGCCTCTGCCYTGGG, CCACAGCCTCTGCCYTGGGCCCC | Syndromic X-linked mental retardation 16 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNA all | Phenotypes |
|---|---|---|---|---|
| 387906718 | FGD1 | NM_004463.2(FGD1):c.196 6C>T (p.Arg66Ter) | CCAACCTCAATCTGCCTGAACC | Aarskog syndrome |
| 118203974 | FGD4 | NM_139241.3(FGD4):c.823 C>T (p.Arg275Ter) | CCAGAGCTGGAGAAAYGAATGC A | Charcot-Marie-Tooth disease, type 4H |
| 121917704 | FGF3 | NM_005247.2(FGF3):c.310 C>T (p.Arg104Ter) | CCATGAACAAGAGGGGAYGACT C | Deafness with labyrinthine aplasia microtia and microdontia (LAMM) |
| 137852660 | FGF8 | NM_033163.3(FGF8):c.77C >T (p.Pro26Leu) | CCTCTAGGAAGGCCYGGGCAGG | Kallmann syndrome 6 |
| 121918322 | FGF9 | NM_002010.2(FGF9):c.296 G>A (p.Ser99Asn) | TATCARTATAGCAGTGGGCCTGG | Multiple synostoses syndrome 3 |
| 515726225 | FGFR1 | NM_023110.2(FGFR1):c.20 84C>T (p.Thr695Ile) | CCAGARTGAAGATCTCCCACAGG | Kallmann syndrome 2 |
| 121909636 | FGFR1 | NM_023110.2(FGFR1):c.20 38C>T (p.Gln680Ter) | CCGGATCTACACCCACYAGAGTG | Kallmann syndrome 2, Delayed puberty |
| 515726224 | FGFR1 | NM_023110.2(FGFR1):c.14 60G>A (p.Gly487Asp) | CCACCTGCCCAAAGCAGYCCTCT, CCTGCCCAAAGCAGYCCTCTCCC | Kallmann syndrome 2 |
| 121918491 | FGFR2 | NM_000141.4(FGFR2):c.10 32G>A (p.Ala344=) | GCTTGGCRGGTAATTCTATTGGG, TGCTTGGCRGGTAATTCTATTGG | Crouzon syndrome, Craniosynostosis |
| 121918509 | FGFR2 | NM_000141.4(FGFR2):c.18 82G>A (p.Ala628Thr) | TTTARCAGCCAGAAATGTTTGG | |
| 121913112 | FGFR3 | NM_000142.4(FGFR3):c.15 37G>A (p.Asp513Asn) | CACAGACRATGCCACTGACAAGG | |
| 351855 | FGFR4 | NM_213647.2(FGFR4):c.11 62G>A (p.Gly388Arg) | CCTGCCCTCGATACAGCCYGGCC, CCCTCGATACAGCCYGGCCAGCA | |
| 104894689 | FKRP | NM_024301.4(FKRP):c.764 G>A (p.Trp255Ter) | CGCTRGAAGGCTGAGCGCGAGG, GCGCTRGAAGGCTGAGCGCGAG G | Limb-girdle muscular dystrophy-dystroglycanopathy, type C5 |
| 104894681 | FKRP | NM_024301.4(FKRP):c.134 3C>T (p.Pro448Leu) | CCCGAGCACTTCCTGCAGCYGCT, CCGACCACTTCCTGCAGCYGCTG | Congenital muscular dystrophy-dystroglycanopathy without mental retardation, type B5 |
| 104894690 | FKRP | NM_024301.4(FKRP):c.400 C>T (p.Arg134Trp) | CCTAGTACCTGATGGGGCYGGG | Limb-girdle muscular dystrophy-dystroglycanopathy, type C5 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587782069 | FLCN | NM_144997.5(FLCN):c.49 9C>T (p.Gln167Ter) | CCTGCCAGGGGCTTCYAGCGCT | Hereditary cancer-predisposing syndrome |
| 398124523 | FLCN | NM_144997.5(FLCN):c.10 60C>T (p.Gln354Ter) | CCCTCCGGCACATGAGGYAGGTA, CCTCCGGCACATGAGGYAGGTAG | not provided |
| 398124532 | FLCN | NM_144997.5(FLCN):c.15 97C>T (p.Gln533Ter) | CCCAAAGAGGACACAYAGAAGC T, CCAAAGAGGACACAYAGAAGCT G | not provided |
| 387907371 | FLNA | NM_001110556.1(FLNA):c. 5217G>A (p.Thr1739=) | TGACRGTGAGGAGGGGTGGGGG G, GTGACRGTGAGGAGGGGTGGGG G, AGTGACRGTGAGGAGGGGGTGGG G, AAGTGACRGTGAGGAGGGGGTGG G, CAAGTGACRGTGAGGAGGGGGTG G | Terminal osseous dysplasia |
| 28935473 | FLNA | NM_001110556.1(FLNA):c. 3596C>T (p.Ser1199Leu) | CCATTGAGATCTGCTYGGAGGCG | Melnick-Needles syndrome |
| 80338841 | FLNA | NM_001110556.1(FLNA):c. 1923C>T (p.Gly641=) | CCGAGGAGGCTGGYGAGTATGC | X-linked periventricular heterotopia, Cardiac valvular dysplasia, X-linked |
| 398123614 | FLNA | NM_001110556.1(FLNA):c. 2761C>T (p.Arg921Ter) | CCAAGGGGGATGCAGTGYGAGA T | X-linked periventricular heterotopia, Oto-palato-digital syndrome, type I, not provided |
| 137853310 | FLNA | NM_001110556.1(FLNA):c. 544C>T (p.Gln182Ter) | CCAGAACAGCTGCCGYAGCTGC | X-linked periventricular heterotopia |
| 137853312 | FLNA | NM_001110556.1(FLNA):c. 3557C>T (p.Ser1186Leu) | CCAAGTGGACTGCTYGAGCCGG | Frontometaphyseal dysplasia |
| 137853317 | FLNA | NM_001110556.1(FLNA):c. 586C>T (p.Arg196Trp) | CCGGGACTGGCAGAGCGGCYGG G | Oto-palato-digital syndrome, type I, Oto-palato-digital syndrome, type II, not provided |
| 80356510 | FLNB | NM_001457.3(FLNB):c.10 88G>A (p.Gly363Glu) | GTCCAGRGTTGGAAGCTGTAGGG, GGTCCAGRGTTGGAAGCTGTAGG | Larsen syndrome, dominant type |
| 80356513 | FLNB | NM_001457.3(FLNB):c.47 56G>A (p.Gly1586Arg) | AAGACTRGGCGCTATATGATTGG | Larsen syndrome, dominant type, Larsen syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80356517 | FLNB | NM_001457.3(FLNB):c.19 45C>T (p.Arg649Ter) | CCTTTGCTTCAGGTTYGAGCATA | Spondylocarpotarsal synostosis syndrome |
| 80356519 | FLNB | NM_001457.3(FLNB):c.24 52C>T (p.Arg818Ter) | CCTCCTGCTGCTGGGYGATACAC | Spondylocarpotarsal synostosis syndrome |
| 121909654 | FLT4 | NM_182925.4(FLT4):c.263 2G>A (p.Val878Met) | GTGGCCRTGAAAATGCTGAAAGG | Hereditary lymphedema type I |
| 121909656 | FLT4 | NM_182925.4(FLT4):c.331 6G>A (p.Glu1106Lys) | CTCTGGRAGATCTTCTCTCTGGG, TCTCTGGRAGATCTTCTCTCTGG | Hereditary lymphedema type I |
| 121909657 | FLT4 | NM_182925.4(FLT4):c.256 3G>A (p.Ala855Thr) | CGGCRCCTTCGGAAGGTGGTGG, CTACGGCRCCTTCGGAAGGTGG | Hereditary lymphedema type I |
| 34255532 | FLT4 | NM_182925.4(FLT4):c.286 0C>T (p.Pro954Ser) | CCGCAGGAGAGAGTCTYCCGAGCA | Hemangioma, capillary infantile |
| 267606819 | FLVCR1 | NM_014053.3(FLVCR1):c. 721G>A (p.Ala241Thr) | CACCRCCCGTGCTGGGCAATCAGG | Posterior column ataxia with retinitis pigmentosa |
| 72549320 | FMO3 | NM_001002294.2(FMO3):c. 94G>A (p.Glu32Lys) | TTTRAGAAGAGCAATGACATTGG | Trimethylaminuria |
| 2266782 | FMO3 | NM_006894.5(FMO3):c.47 2G>A (p.Glu158Lys) | AAAARAGTCCTTTCCAGGTAAGG | Trimethylaminuria |
| 72549326 | FMO3 | NM_006894.5(FMO3):c.45 8C>T (p.Pro153Leu) | CCGGACATCATGTGTATCYCAAC | Trimethylaminuria |
| 79691946 | FOXC1 | NM_001453.2(FOXC1):c.8 89C>T (p.Pro2975er) | CCGCGCCGCCCGCGYCCTCCGC | Iridogoniodysgenesis type1, not specified, not provided |
| 104893952 | FOXC1 | NM_001453.2(FOXC1):c.6 7C>T (p.Gln23Ter) | CCCTACCTCCGCGGCGAGYAGAG, CCTACCTCCGGCGGCGAGYAGAGC | Axenfeld-Rieger syndrome type 3 |
| 104893957 | FOXC1 | NM_001453.2(FOXC1):c.3 92G>T (p.Ser131Leu) | CCGCCACAACCTCTYGCTCAACG | Axenfeld-Rieger syndrome type 3 |
| 786205000 | FOXG1 | NM_005249.4(FOXG1):c.1 36C>T (p.Gln46Ter) | CCACAACAGCCACCACCCCYAGC | not provided |
| 786205006 | FOXG1 | NM_005249.4(FOXG1):c.6 10C>T (p.Leu204Phe) | CCCCGAGAAGCGGCTCACGYTCA, CCCGAGAAGCGGCTCACGYTCAA, CCGAGAAGCGGCTCACGYTCAAC | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796052467 | FOXG1 | NM_005249.4(FOXG1):c.7 01C>T (p.Ser234Phe) | CCATCGCCACAATCTGTYCCTC, CCGCCACAATCTGTYCCTCAACA | not provided |
| 796052458 | FOXG1 | NM_005249.4(FOXG1):c.2 17C>T (p.Gln73Ter) | CCGCCGCCGCAGCAGCAGYAGCC, CCGCCGCAGCAGCAGYAGCCGCC | not provided |
| 387906920 | FOXL2 | NM_023067.3(FOXL2):c.2 05G>A (p.Glu69Lys) | TCCGCRAGAGCGCGGAGAGAG G | |
| 104893739 | FOXL2 | NM_023067.3(FOXL2):c.5 86C>T (p.Gln196Ter) | CCCCCCAAGTACCTGYAGTCTGG, CCCCCAAGTACCTGYAGTCTGGC | Blepharophimosis, ptosis, and epicanthus inversus |
| 104893741 | FOXL2 | NM_023067.3(FOXL2):c.6 55C>T (p.Gln219Ter) | CCCTATGCCTCCTGCYAGATGGC, CCTATGCCTCCTGCYAGATGGCG | Blepharophimosis, ptosis, and epicanthus inversus |
| 122467174 | FOXP3 | NM_014009.3(FOXP3):c.3 G>A (p.MetIIle) | CCGATRCCCAACCCCAGGCCTGG | Insulin-dependent diabetes mellitus secretory diarrhea syndrome |
| 120074156 | FRAS1 | NM_025074.6(FRAS1):c.86 02C>T (p.Gln2868Ter) | CCTGGTGTCATTGAAYAGTGCG | Cryptophthalmos syndrome |
| 137852209 | FRMD7 | NM_194277.2(FRMD7):c.2 52G>A (p.Val84=) | AGTRGACCCTGGACATCTGCGGG, CAGTRGACCCTGGACATCTGCGG | Infantile nystagmus, X-linked |
| 137852208 | FRMD7 | NM_194277.2(FRMD7):c.1 003C>T (p.Arg335Ter) | CCCATCTCAGTACCATGAAYGAC, CCATCTCAGTACCATGAAYGACA | Infantile nystagmus, X-linked |
| 121909660 | FSHR | NM_000145.3(FSHR):c.171 7C>T (p.Arg573Cys) | CCAGGATCGCCAAGYGCATGGCC | Ovarian dysgenesis 1 |
| 28941768 | FTCD | NM_006657.2(FTCD):c.40 3C>T (p.Arg135Cys) | CCAGGATGGACAGTYGCCGGACC | Glutamate formiminotransferase deficiency |
| 104894685 | FTL | NM_000146.3(FTL):c.286G >A (p.Ala96Thr) | AGARCCATGATGAAAGCTGCCATGG | Neuroferritinopathy |
| 397514540 | FTL | NM_000146.3(FTL):c.89C> T (p.Thr30Ile) | CCTGCAGGCCTCCTACAYCTACC | Hyperferritinemia cataract syndrome |
| 121909669 | FUS | NM_004960.3(FUS):c.1553 G>A (p.Arg518Lys) | ACARACAGGATCGCAGGGAGAG G, TGAGCACARACAGGATCGCAGG G | Amyotrophic lateral sclerosis type 6 |
| 267606831 | FUS | NM_004960.3(FUS):c.1520 G>A (p.Gly507Asp) | TGGCTTTGRCCCTGCAAGATGG | Amyotrophic lateral sclerosis type 6 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906628 | FUS | NM_004960.3(FUS):c.616G>A (p.Gly206Ser) | CAGCRGTGGCTATGACAGCAGG | Amyotrophic lateral sclerosis type 6 |
| 104894569 | G6PC | NM_000151.3(G6PC):c.551G>A (p.Gly184Glu) | GCTGRAGTCCTGTCAGGTATGGG, TGCTGRAGTCCTGTCAGGTATGG | Glycogen storage disease type 1A |
| 1801176 | G6PC | NM_000151.3(G6PC):c.248G>A (p.Arg83His) | TGGACAGCRTCCATACTGGTGGG | Glucose-6-phosphate transport defect |
| 137852316 | G6PD | NM_000402.4(G6PD):c.1268G>A (p.Arg423His) | GATCCRCGTCCAGCCCAACCAGG | Anemia, nonspherocytic hemolytic, due to G6PD deficiency |
| 137852346 | G6PD | NM_000402.4(G6PD):c.896G>A (p.Cys299Tyr) | GATGCTGTRTCTGGTGGCCATGG | Anemia, nonspherocytic hemolytic, due to G6PD deficiency |
| 267606836 | G6PD | NM_000402.4(G6PD):c.634C>T (p.Arg212Trp) | CCTCGCAGAGCTCTGACYGGCTGT | |
| 398123546 | G6PD | NM_000402.4(G6PD):c.1450C>T (p.Arg484Cys) | CCAGATGCACTTCGTGYGCAGGT | Favism, susceptibility to, Anemia, nonspherocytic hemolytic, due to G6PD deficiency, not provided |
| 137852330 | G6PD | NM_000402.4(G6PD):c.682C>T (p.Arg228Cys) | CCGTGAGGACCAGATCTACYGCA | |
| 137852334 | G6PD | NM_000402.4(G6PD):c.1249C>T (p.Arg417Cys) | CCACCAGCAGTGCAAGYGCAACG | Anemia, nonspherocytic hemolytic, due to G6PD deficiency |
| 137852345 | G6PD | NM_000402.4(G6PD):c.1172C>T (p.Ala391Val) | CCTCGCTGCGGCAAGGYCCTGA | |
| 28937909 | GAA | NM_000152.3(GAA):c.1927G>A (p.Gly643Arg) | CTGGTCRGGGCCGACGTCTGCGG | GLYCOGEN STORAGE DISEASE II, ADULT FORM |
| 796051877 | GAA | NM_000152.3(GAA):c.1437G>A (p.Lys479=) | GAARGTAGGGCGAGGGTCCAGG, GGAARGTAGGGCGAGGGTCCAGG | Glycogen storage disease, type II |
| 369532274 | GAA | NM_000152.3(GAA):c.2512C>T (p.Gln838Ter) | CCAGAGAGTCCCGCYAGCAGCCC | Glycogen storage disease, type II, not provided |
| 121907942 | GAA | NM_000152.3(GAA):c.1634C>T (p.Pro545Leu) | CCCACCCTACGTGCYTGGTCAGC | GLYCOGEN STORAGE DISEASE II, ADULT FORM |
| 121907943 | GAA | NM_000152.3(GAA):c.2560C>T (p.Arg854Ter) | CCAAGGGTGGGAGGCCYGAGGG | Glycogen storage disease, type II |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777308 | GABRA1 | NM_000806.5(GABRA1):c.335G>A (p.Arg112Gln) | CCTCRGTTAAATAACCTAATGG | Epileptic encephalopathy, early infantile, 19, not specified, not provided |
| 397514737 | GABRG2 | NM_000816.3(GABRG2):c.968G>A (p.Arg323Gln) | TGCCCRGAAATCGCTCCCAAGG | Generalized epilepsy with febrile seizures plus 3, not provided |
| 121909673 | GABRG2 | NM_000816.3(GABRG2):c.245G>A (p.Arg82Gln) | AAACTTCRGCCTGATATAGGAGG | Epilepsy, childhood absence 2, Familial febrile seizures 8, not provided |
| 121909674 | GABRG2 | NM_198903.2(GABRG2):c.1312C>T (p.Gln438Ter) | CCCAAGATCAGCAACCATTYAAA, CCAAGATCAGCAACCATTYAAAT | Generalized epilepsy with febrile seizures plus 3 |
| 796052504 | GABRG2 | NM_000816.3(GABRG2):c.406C>T (p.Arg136Ter) | CCATTAAAGTCCTCYGATTGAAC | not provided |
| 28940882 | GALE | NM_000403.3(GALE):c.269G>A (p.Gly90Glu) | TTTGCGGRGCTCAAGGCCGTGGG, CTTTGCGGRGCTCAAGGCCGTGG | UDPglucose-4-epimerase deficiency |
| 28940885 | GALE | NM_000403.3(GALE):c.956G>A (p.Gly319Glu) | TGGRGTGGACAGCAGCCTTAGGG, CTGGRGTGGACAGCAGCCTTAGG | UDPglucose-4-epimerase deficiency, not provided |
| 137853860 | GALE | NM_000403.3(GALE):c.715C>T (p.Arg239Trp) | CCCTTCTCTGCAGGTGTCYGGGA, CCTTCTCTGCAGGTGTCYGGGAT | UDPglucose-4-epimerase deficiency |
| 111033608 | GALK1 | NM_000154.1(GALK1):c.1144C>T (p.Gln382Ter) | CCACCTTCTACCTCTCTYAAGCA, CCTTCTACCTCTCTYAAGCAGCC | Deficiency of galactokinase |
| 118204447 | GALNS | NM_000512.4(GALNS):c.178G>A (p.Asp60Asn) | TTGRACCGATGGCTGCAGAAGG | Mucopolysaccharidosis, MPS-IV-A |
| 398123438 | GALNS | NM_000512.4(GALNS):c.463G>A (p.Gly155Arg) | CACRGATTTGATGAGTGGTTTGG, TGAAGCACRGATTTGATGAGTGG | Mucopolysaccharidosis, MPS-IV-A, not provided |
| 118204437 | GALNS | NM_000512.4(GALNS):c.1156C>T (p.Arg386Cys) | CCTATCTTCTATTACYGTGCGA | Mucopolysaccharidosis, MPS-IV-A, not provided |
| 367543255 | GALT | NM_000155.3(GALT):c.389G>A (p.Cys130Tyr) | CATGTRCTTCCACCCCTGGTCGG | Deficiency of UDPglucose-hexose-1-phosphate uridylyltransferase |
| 111033829 | GALT | NM_000155.3(GALT):c.98G>A (p.Arg33His) | TATCCRCTACAACCCGCTGCAGG | Deficiency of UDPglucose-hexose-1-phosphate uridylyltransferase |
| 111033675 | GALT | NM_000155.3(GALT):c.368G>A (p.Arg123Gln) | CTCRAGGAGTCTGGTAACTATGG | Deficiency of UDPglucose-hexose-1-phosphate uridylyltransferase |
| 111033694 | GALT | NM_000155.3(GALT):c.443G>A (p.Arg148Gln) | TCCRGGCTGTTGTTGATGCATGG | Deficiency of UDPglucose-hexose-1-phosphate uridylyltransferase |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 111033704 | GALT | NM_000155.3(GALT):c.46 2G>A (p.Trp154Ter) | TGCATGRGCCTCAGTCACAGAGG | Deficiency of UDPglucose-hexose-1-phosphate uridylyltransferase |
| 111033723 | GALT | NM_000155.3(GALT):c.56 4+1G>A | CTGCCAGRTAAGGGTGTCAGGGG, ACTGCCAGRTAAGGGTGTCAGGG | Deficiency of UDPglucose-hexose-1-phosphate uridylyltransferase |
| 111033736 | GALT | NM_000155.3(GALT):c.60 7G>A (p.Glu203Lys) | GCGTGAGRAGCGATCTCAGCAGG | Deficiency of UDPglucose-hexose-1-phosphate uridylyltransferase |
| 111033747 | GALT | NM_000155.3(GALT):c.65 8G>A (p.Glu220Lys) | GCTAATGRAGTACAGCCGCCAGG | Deficiency of UDPglucose-hexose-1-phosphate uridylyltransferase |
| 111033784 | GALT | NM_000155.3(GALT):c.92 2G>A (p.Glu308Lys) | GATCARAGGCTGGGGCCAACTGG | Deficiency of UDPglucose-hexose-1-phosphate uridylyltransferase |
| 111033802 | GALT | NM_000155.3(GALT):c.98 3G>A (p.Arg328His) | TCCTGCRCTCTGCCACTGTCCGG | Deficiency of UDPglucose-hexose-1-phosphate uridylyltransferase |
| 367543268 | GALT | NM_000155.3(GALT):c.10 60-1G>A | CCARGCTGCAGAGAGACTAAGG G, TCCARGCTGCAGAGAGACTAAGG | Deficiency of UDPglucose-hexose-1-phosphate uridylyltransferase |
| 367543266 | GALT | NM_000155.3(GALT):c.96 1C>T (p.His321Tyr) | CCATTGGCAGCTGCACGCTYATT | Deficiency of UDPglucose-hexose-1-phosphate uridylyltransferase |
| 111033739 | GALT | NM_000155.3(GALT):c.60 1C>T (p.Arg201Cys) | CCTGCCAGATATTGCCCAGYGTG, CCAGATATTGCCCAGYGTGAGGA | Deficiency of UDPglucose-hexose-1-phosphate uridylyltransferase |
| 111033774 | GALT | NM_000155.3(GALT):c.86 5C>T (p.Leu289Phe) | CCAAGTATGACAACYTCTTTGAG | Deficiency of UDPglucose-hexose-1-phosphate uridylyltransferase |
| 111033803 | GALT | NM_000155.3(GALT):c.98 6C>T (p.Ser329Phe) | CCCTCCGCTCCTGCGCTYTGCCA, CCTCCGCTCCTGCGCTYTGCCAC | Deficiency of UDPglucose-hexose-1-phosphate uridylyltransferase |
| 111033804 | GALT | NM_000155.3(GALT):c.98 9C>T (p.Ala330Val) | CCTCCGCTCCTGCCGCTCTGYCAC, CCGCTCCTGCGCTCTGYCACTGT | Deficiency of UDPglucose-hexose-1-phosphate uridylyltransferase |
| 367543259 | GALT | NM_000155.3(GALT):c.54 2C>T (p.Ser181Phe) | CCATGATGGGCTGTTYTAACCCC | Deficiency of UDPglucose-hexose-1-phosphate uridylyltransferase |
| 368166217 | GALT | NM_000155.3(GALT):c.77 2C>T (p.Arg258Cys) | CCAGACACTGCTGCTGCCCYGTC | Deficiency of UDPglucose-hexose-1-phosphate uridylyltransferase |
| 111033649 | GALT | NM_000155.3(GALT):c.16 0C>T (p.Gln54Ter) | CCGCATGAAGCGGCCCTGGYAGG | Deficiency of UDPglucose-hexose-1-phosphate uridylyltransferase |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 111033686 | GALT | NM_000155.3(GALT):c.413C>T (p.Thr138Met) | CCCTGGTCGATGTAAYGCTGC, CCCTGGTCGATGTAAYGCTGCC, CCTGGTCGGATGTAAYGCTGCCA | Deficiency of UDPglucose-hexose-1-phosphate uridylyltransferase |
| 111033845 | GALT | NM_000155.3(GALT):c.770C>T (p.Pro257Leu) | CCAGACACTGCTGCTYGCYCTG | Deficiency of UDPglucose-hexose-1-phosphate uridylyltransferase |
| 121909272 | GAMT | NM_000156.5(GAMT):c.506G>A (p.Cys169Tyr) | ACTRCAACCTCACCTCCTGGGG, TACTRCAACCTCACCTCCTGGGG, CTACTRCAACCTCACCTCCTGGG, CCTACTRCAACCTCACCTCCTGG | Deficiency of guanidinoacetate methyltransferase |
| 80338735 | GAMT | NM_000156.5(GAMT):c.327G>A (p.Lys109=) | CAARGTGCCCCTCTGCCCCGAGG | Deficiency of guanidinoacetate methyltransferase, not provided |
| 119485089 | GAN | NM_022041.3(GAN):c.1447C>T (p.Gln483Ter) | CCGAAGTCGTGAGGACGCCYAG G | Giant axonal neuropathy |
| 104894809 | GATA1 | NM_002049.3(GATA1):c.647G>A (p.Arg216Gln) | CTGTGGCRGAGGGACAGGACAG G | Thrombocytopenia, platelet dysfunction, hemolysis, and imbalanced globin synthesis |
| 387907207 | GATA1 | NM_002049.3(GATA1):c.646C>T (p.Arg216Trp) | CCACTCCACTGTGGYGGAGGGAC | Thrombocytopenia, platelet dysfunction, hemolysis, and imbalanced globin synthesis |
| 387906630 | GATA2 | NM_001145661.1(GATA2):c.761C>T (p.Pro254Leu) | CCTACCCCTCCTATGTGCYGGCG, CCCCTCCTATGTGCYGGGCGCTG | Dendritic cell, monocyte, B lymphocyte, and natural killer lymphocyte deficiency |
| 387906632 | GATA2 | NM_001145661.1(GATA2):c.1009C>T (p.Arg337Ter) | CCACTCATCAAGCCCAAGYAAAG | Lymphedema, primary, with myelodysplasia |
| 104894162 | GATA3 | NM_001002295.1(GATA3):c.829C>T (p.Arg277Ter) | CCCCACTGTGCGCYGGYGAGATGGC | Barakat syndrome |
| 56208331 | GATA4 | NM_002052.4(GATA4):c.1273G>A (p.Asp425Asn) | GCAGRACTCTTGGAACAGAGCCTGG | Multiple congenital anomalies, Tetralogy of Fallot, Atrial septal defect 2 |
| 104894074 | GATA4 | NM_002052.4(GATA4):c.155C>T (p.Ser52Phe) | CCTTCCGTGCTGGGCCTGTYCTAC, CCGTGCTGGGCCTGTYCTACCTC | Atrial septal defect 2 |
| 115372595 | GATA4 | NM_002052.4(GATA4):c.1037C>T (p.Ala346Val) | CCTCCCGCCAGCGGTGYTTCCAG | Atrioventricular septal defect 4 |
| 387906769 | GATA4 | NM_002052.4(GATA4):c.487C>T (p.Pro163Ser) | CCTACTCCAGCCCCTACYCGGCT | Tetralogy of Fallot, Ventricular septal defect 1, Atrioventricular septal defect 4 |
| 387906771 | GATA4 | NM_002052.4(GATA4):c.839C>T (p.Thr280Met) | CCAGACCACCACCAYGCTGT | Atrial septal defect 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906819 | GATA6 | NM_005257.5(GATA6):c.1367G>A (p.Arg456His) | TTATGGCRCAGAAACGCCGAGGG, CTTATGGCRCAGAAACGCCGAGG | Pancreatic agenesis and congenital heart disease |
| 80356772 | GBA | NM_000157.3(GBA):c.1505G>A (p.Arg502His) | AACCRGTGAGGGCAATGGTGAGG | Gaucher disease |
| 121908311 | GBA | NM_000157.3(GBA):c.1246G>A (p.Gly416Ser) | ATGTGGTCRGCTGGACCGACTGG | Gaucher disease, Subacute neuronopathic Gaucher disease, Gaucher disease, type 1 |
| 121908298 | GBA | NM_001005741.2(GBA):c.983C>T (p.Pro328Leu) | CCAACGCTTGCTGCTGCYCCACT | Gaucher disease, type 1 |
| 398123532 | GBA | NM_001005741.2(GBA):c.625C>T (p.Arg209Cys) | CCCTGCAGTTGGCCCAGYGTCCC, CCTGCAGTTGGCCCAGYGTCCCG | Gaucher disease, type 1, not provided |
| 398123015 | GBA2 | NM_020944.2(GBA2):c.2618G>A (p.Arg873His) | TCCRCTCACTGGCCTACATGCGG | |
| 398123013 | GBA2 | NM_020944.2(GBA2):c.700C>T (p.Arg234Ter) | CCATGCCCCTATCCCYGAGCCT | |
| 80338673 | GBE1 | NM_000158.3(GBE1):c.1571G>A (p.Arg524Gln) | TGATTCRACTCATTACGCATGGG, ATGATTCRACTCATTACGCATGG | Glycogen storage disease, type IV, GLYCOGEN STORAGE DISEASE IV, COMBINED HEPATIC AND MYOPATHIC |
| 786205862 | GCDH | NM_000159.3(GCDH):c.675G>A (p.Trp225Ter) | GTGTGRGCTCGGTGTGAAGATGG | Glutaric aciduria, type 1 |
| 147611168 | GCDH | NM_000159.3(GCDH):c.1240G>A (p.Glu414Lys) | ACACCTACRAAGGTAGGAGAGCTGG | Glutaric aciduria, type 1, not provided |
| 104894438 | GCH1 | NM_000161.2(GCH1):c.602G>A (p.Gly201Glu) | GCCTGCTGRAGTCGGGGTAGTGG | Dystonia 5, Dopa-responsive type |
| 104894443 | GCH1 | NM_000161.2(GCH1):c.633G>A (p.Met211Ile) | CACATRTGTATGGTAATGCCAGG | GTP cyclohydrolase I deficiency |
| 104894444 | GCH1 | NM_000161.2(GCH1):c.142C>T (p.Gln48Ter) | CCCGAGGCCAAGAGCGCGYAGCC, CCGAGGCCAAGAGCGCGYAGCCC | Dystonia 5, Dopa-responsive type |
| 193922289 | GCK | NM_000162.3(GCK):c.214G>A (p.Gly72Arg) | AGTCRGGGACTTCCTCCCCTGG | Maturity-onset diabetes of the young, type 2 |
| 104894008 | GCK | NM_000162.3(GCK):c.781G>A (p.Gly261Arg) | CTTCRGGGACTCCGCGAGCTGG | Maturity-onset diabetes of the young, type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894012 | GCK | NM_000162.3(GCK):c.1363G>A (p.Val455Met) | CTCGGCGRTGGCCTGTAAGAAGG | Hyperinsulinemic hypoglycemia familial 3 |
| 104894016 | GCK | NM_000162.3(GCK):c.1132G>A (p.Ala378Thr) | GCGCRCTGCCACATGTGCTCGG | Maturity-onset diabetes of the young, type 2 |
| 397514580 | GCK | NM_000162.3(GCK):c.1015G>A (p.Glu339Lys) | GGTGRAGAGGTGTGCGGAGGAG, GCAGGTGRAGAGGTGTGCGGAG, G | Maturity-onset diabetes of the young, type 2 |
| 587780347 | GCK | NM_000162.3(GCK):c.706G>A (p.Glu236Lys) | CATGRAGGAGATGCAGAATGTGG | Diabetes mellitus, gestational |
| 104894014 | GCK | NM_000162.3(GCK):c.1367C>T (p.Ala456Val) | CCCTGGTCTTCGGCGGTGGYCTGT, CCTGGTCTCGGCGGTGGYCTGTA | Hyperinsulinemic hypoglycemia familial 3 |
| 80356655 | GCK | NM_000162.3(GCK):c.683C>T (p.Thr228Met) | CCGACCTCCACCCAGGCAYGGG, CCTCACCCCAGGCAYGGCTGC | Permanent neonatal diabetes mellitus, Maturity-onset diabetes of the young, type 2 |
| 56141211 | GCNT2 | NM_001491.2(GCNT2):c.1043G>A (p.Gly348Glu) | ATGRAAACGAGACTTAAAGTGG | I blood group system |
| 137853339 | GCNT2 | NM_145649.4(GCNT2):c.505G>A (p.Ala169Thr) | CCAGRCTGACCTGAACTGCCTGG | I blood group system |
| 397515432 | GDAP1 | NM_018972.2(GDAP1):c.980G>A (p.Gly327Asp) | GTTGRTTTGCTTGCAGGAGTGGG, GGTTGRTTTGCTTGCAGGAGTGG | Charcot-Marie-Tooth disease, recessive intermediate A |
| 387906946 | GDF3 | NM_020634.1(GDF3):c.820C>T (p.Arg274Trp) | CCAGCTATTCATTAACTTCYGGG | Microphthalmia, isolated, with coloboma 6 |
| 36119840 | GDNF | NM_000514.3(GDNF):c.277C>T (p.Arg93Trp) | TGCCRATTCCGCTCTCTTCTAGG | Congenital central hypoventilation, Hirschsprung disease 3, not specified |
| 58064122 | GFAP | NM_002055.4(GFAP):c.715C>T (p.Arg239Cys) | CCCTGAAAGAGATCYGCACCCAG | Alexander disease, not provided |
| 121908192 | GFER | NM_055262.2(GFER):c.581G>A (p.Arg194His) | ATGAGCRCTGGCGCGACGGCTGG | Myopathy, mitochondrial progressive, with congenital cataract, hearing loss, and developmental delay, not provided |
| 119470019 | GFM1 | NM_024996.5(GFM1):c.139C>T (p.Arg47Ter) | CCTAATGAAAAAATAYGAAATAT | Combined oxidative phosphorylation deficiency 1 |
| 121909678 | GGCX | NM_000821.6(GGCX):c.1672G>A (p.Gly558Arg) | GCTGCAGRGGAAGTGACTGTGG | Pseudoxanthoma elasticum-like disorder with multiple coagulation factor deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909682 | GGCX | NM_000821.6(GGCX):c.1427G>A (p.Arg476His) | TGACCRCTTCCAGCAGAGTGGG, ATGACCRCTTCCAGCAGAGTGG | Pseudoxanthoma elasticum-like disorder with multiple coagulation factor deficiency |
| 121909683 | GGCX | NM_000821.6(GGCX):c.763G>A (p.Val255Met) | TGCTCGTCRTGCACTGGGGTGGG | Pseudoxanthoma elasticum-like disorder with multiple coagulation factor deficiency |
| 121909680 | GGCX | NM_000821.6(GGCX):c.1120C>T (p.Gln374Ter) | CCTGCTCTACCTCCTGGAGYAGC | Pseudoxanthoma elasticum-like disorder with multiple coagulation factor deficiency |
| 121909684 | GGCX | NM_000821.6(GGCX):c.899C>T (p.Ser300Phe) | CCTAGGTATGTTCYCTACGTCA | Pseudoxanthoma elasticum-like disorder with multiple coagulation factor deficiency |
| 387907000 | GIPC3 | NM_133261.2(GIPC3):c.903G>A (p.Trp301Ter) | AGTGTGRGCCGCCATCGGCCAGG | Deafness, autosomal recessive 15 |
| 387907002 | GIPC3 | NM_133261.2(GIPC3):c.565C>T (p.Arg189Cys) | CCCAGCCCTTCACCCTGYGCCTG, CCAGCCCTTCACCCTGYGCCTGG | Deafness, autosomal recessive 15 |
| 104893963 | GJA1 | NM_000165.4(GJA1):c.61G>A (p.Gly21Arg) | CAACTGCTRGAGGGAAGGTGGG | Oculodentodigital dysplasia |
| 104893965 | GJA1 | NM_000165.4(GJA1):c.1127G>A (p.Arg376Gln) | CAGACCTCRGCCTGATGACCTGG | Hypoplastic left heart syndrome, Atrioventricular septal defect and common atrioventricular junction |
| 28931600 | GJA1 | NM_000165.4(GJA1):c.427G>A (p.Gly143Ser) | CATRGTAAGGTGAAAATGCGAGG | Syndactyly type 3 |
| 387906616 | GJA1 | NM_000165.4(GJA1):c.31C>T (p.Leu11Phe) | CCTTAGGCAAACTCYTTGACAAG | Oculodentodigital dysplasia |
| 397514703 | GJA3 | NM_021954.3(GJA3):c.5G>A (p.Gly2Asp) | ATGRCGACTGGAGCTTTCTGGG, AATGRCGACTGGAGCTTTCTGG | Zonular pulverulent cataract 3 |
| 398122937 | GJA3 | NM_021954.3(GJA3):c.427G>A (p.Gly143Arg) | GCATCGCCRGGGCGCTGCTCGG | Zonular pulverulent cataract 3 |
| 121917825 | GJA3 | NM_021954.3(GJA3):c.560C>T (p.Pro187Leu) | CCGCTGGCCCTGCCYCAACACGG | Zonular pulverulent cataract 3 |
| 387906612 | GJA5 | NM_005266.6(GJA5):c.145C>T (p.Gln49Ter) | CCTGGGGGATGAGYAGGCTGAT | Atrial fibrillation, familial, 11 |
| 397515627 | GJA8 | NM_005267.4(GJA8):c.566C>T (p.Pro189Leu) | CCGGTGGCCCTGCCYCAATGTGG | Cataract 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 786204123 | GJB1 | NM_000166.5(GJB1):c.425 G>A (p.Arg142Gln) | GGTGTTCCRGCTGTTGTTTGAGG | Charcot-Marie-Tooth Neuropathy X |
| 104894814 | GJB1 | NM_001097642.2(GJB1):c.658C>T (p.Arg220Ter) | CCGGGCCTGTGCCCGCYGAGCCC | X-linked hereditary motor and sensory neuropathy |
| 104894824 | GJB1 | NM_000166.5(GJB1):c.164 C>T (p.Thr55Ile) | CCTTCATCTGCAACAYACTCCAG | X-linked hereditary motor and sensory neuropathy |
| 587777876 | GJB1 | NM_000166.5(GJB1):c.77C>T (p.Ser26Leu) | CCGAGTATGCTCTYGGTCATCT | X-linked hereditary motor and sensory neuropathy |
| 587777879 | GJB1 | NM_000166.5(GJB1):c.790 C>T (p.Arg264Cys) | CCCTGAAAGACATACTGYGCCGC, CCTGAAAGACATACTGYGCCGCA | X-linked hereditary motor and sensory neuropathy |
| 587781246 | GJB1 | NM_000166.5(GJB1):c.688 C>T (p.Arg230Cys) | CCGCTCCAATCCACCTTCCYGCA, CCAATCCACCTTCCYGCAAGGGC | Charcot-Marie-Tooth disease |
| 116840819 | GJB1 | NM_000166.5(GJB1):c.223 C>T (p.Arg75Trp) | CCCCATCTCCCATGTGYGGCTGT, CCCATCTCCCATGTGYGGCTGTG, CCATCTCCCATGTGYGGCTGTGG | X-linked hereditary motor and sensory neuropathy |
| 587783645 | GJB2 | NM_004004.5(GJB2):c.158 G>A (p.Cys53Tyr) | GTCTRCAACACCCTGCAGCCAGG | Hearing impairment |
| 80338940 | GJB2 | NM_004004.5(GJB2):c.-23+1G>A | GCAGRTGAGCCGCCGGCCCCGG | Deafness, autosomal recessive 1A, Hearing impairment |
| 104894402 | GJB2 | NM_004004.5(GJB2):c.223 C>T (p.Arg75Trp) | CCCCATCTCCCACATCYGGCTAT, CCCATCTCCCACATCYGGCTATG, CCATCTCCCACATCYGGCTATGG | Deafness, autosomal dominant 3a |
| 76434661 | GJB2 | NM_004004.5(GJB2):c.416 G>A (p.Ser139Asn) | CCCGAAGAAGATGTGCTTGTG | Deafness, autosomal recessive 1A, Hearing impairment |
| 72555392 | GLB1 | NM_000404.2(GLB1):c.176 G>A (p.Arg59His) | CCCRTGTGCCCGCTTCTACTGG | Mucopolysaccharidosis, MPS-IV-B, Infantile GM1 gangliosidosis, Juvenile GM>1< gangliosidosis, Gangliosidosis GM1 type 3, GM1-GANGLIOSIDOSIS, TYPE I, WITH CARDIAC INVOLVEMENT, not provided |
| 398123351 | GLB1 | NM_000404.2(GLB1):c.1769G>A (p.Arg590His) | GGCCRCTATTGGCCAGCCCGGGG, TTGGCCRCTATTGGCCAGCCCGG | Mucopolysaccharidosis, MPS-IV-B, Infantile GM1 gangliosidosis, Juvenile GM>1< gangliosidosis, Gangliosidosis GM1 type 3, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123353 | GLB1 | NM_000404.2(GLB1):c.397-1G>A | ACTARGGAGGATTACCTGCTTGG | Mucopolysaccharidosis, MPS-IV-B, Infantile GM1 gangliosidosis, Juvenile GM>1 < gangliosidosis, Gangliosidosis GM1 type 3, not provided |
| 72555359 | GLB1 | NM_000404.2(GLB1):c.1369C>T (p.Arg457Ter) | CCCCCAGGGAGTCCTTGAGYGAA, CCCAGGGAGTCCTTGAGYGAAA, CCCAGGGAGTCCTTGAGYGAAAC, CCAGGGAGTCCTTGAGYGAACA | Infantile GM1 gangliosidosis |
| 72555366 | GLB1 | NM_000404.2(GLB1):c.622C>T (p.Arg208Cys) | CCTGCAGAGAGCGCTTTYGCCACC | Mucopolysaccharidosis, MPS-IV-B, Infantile GM1 gangliosidosis, Juvenile GM>1< gangliosidosis, Gangliosidosis GM1 type 3, not provided |
| 72555370 | GLB1 | NM_000404.2(GLB1):c.202C>T (p.Arg68Trp) | CCGCTTCTACTGGAAGGACYGGC | Juvenile GM> 1 < gangliosidosis |
| 121964980 | GLDC | NM_000170.2(GLDC):c.2216G>A (p.Arg739His) | TCTGTCRCCCTGGAGACTTCGGG, ATCTGTCRCCCTGGAGACTTCGG | Non-ketotic hyperglycinemia |
| 121964977 | GLDC | NM_000170.2(GLDC):c.2405C>T (p.Ala802Val) | CCTGTGGGAACCGTCAGTGYGGC | Non-ketotic hyperglycinemia |
| 281917707 | GLI2 | NM_005270.4(GLI2):c.1323G>A (p.Trp441Ter) | CCACTGRGAAGACTGCACCAAGG | Holoprosencephaly 9 |
| 116840748 | GLI3 | NM_000168.5(GLI3):c.2110C>T (p.Gln704Ter) | CCCCAACAGACATCTYAGCCAAG, CCCAACAGACATCTYAGCCAAGC | Pallister-Hall syndrome |
| 116840770 | GLI3 | NM_000168.5(GLI3):c.3481C>T (p.Gln1161Ter) | CCGACCTGCCCATTYAGTGAAC | Pallister-Hall syndrome |
| 281864919 | GLRA1 | NM_000171.3(GLRA1):c.1259G>A (p.Arg420His) | ATCCCRCATTGGCTTCCCCATGG | Hyperekplexia hereditary |
| 116474260 | GLRA1 | NM_001146040.1(GLRA1):c.1132G>A (p.Gly378Ser) | CCTGTAGACAGGCTGGGCYCATC | Hyperekplexia hereditary |
| 121909749 | GLRB | NM_000824.4(GLRB):c.752G>A (p.Gly251Asp) | GAAAGRCTACTACACATGCGTGG | Hyperekplexia 2 |
| 121909736 | GLUD1 | NM_005271.3(GLUD1):c.953G>A (p.Arg318Lys) | ATGARATATTTACATCGTTTTGG | Hyperinsulinism-hyperammonemia syndrome |
| 397509422 | GMPPB | NM_013334.3(GMPPB):c.1081G>A (p.Asp361Asn) | CCGTTGAGGTAGAGAGCTCATYATT | Limb-girdle muscular dystrophy-dystroglycanopathy, type C14, Congenital muscular dystrophy-dystroglycanopathy with brain and eye anomalies, type A14 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397509423 | GMPPB | NM_013334.3(GMPPB):c.20C>T (p.Arg74Ter) | CCTTCCAGCTGGGAATCYGAATC | Congenital muscular dystrophy-dystroglycanopathy with brain and eye anomalies, type A14 |
| 397509424 | GMPPB | NM_013334.3(GMPPB):c.4C>T (p.Pro22Ser) | CCGCTGACGCTGAGCACCYCGAA | Limb-girdle muscular dystrophy-dystroglycanopathy, type C14 |
| 397509425 | GMPPB | NM_021971.2(GMPPB):c.53C>T (p.Arg185Cys) | CCCTGCAGTGCTGCAGYGCATCC, CCTGCAGTGCTGCAGYGCATCCA | Limb-girdle muscular dystrophy-dystroglycanopathy, type C14, Congenital muscular dystrophy-dystroglycanopathy with brain and eye anomalies, type A14, Congenital muscular dystrophy-dystroglycanopathy with mental retardation, type B14 |
| 202160208 | GMPPB | NM_013334.3(GMPPB):c.8 60G>A (p.Arg287Gln) | CCGCAGCACCGTGCACCGCYGGA | Congenital muscular dystrophy-dystroglycanopathy with mental retardation, type B14 |
| 137853227 | GNAI2 | NM_002070.3(GNAI2):c.53 6G>A (p.Arg179His) | GGACCCRCGTAAAGACCACGG, CGGACCCRCGTAAAGACCACGGG, ACGGACCCRCGTAAAGACCACGG | Granulosa cell tumor of the ovary |
| 398122923 | GNAL | NM_001142339.2(GNAL): c.409G>A (p.Val137Met) | TGACCATRTGAAAAAACTTTGGG, TTGACCATRTGAAAAAACTTTGG | Dystonia 25 |
| 397514698 | GNAQ | NM_002072.4(GNAQ):c.54 8G>A (p.Arg183Gln) | GAGTTCRAGTCCCCACCAGGG, AGAGTTCRAGTCCCCACCACAGG | Sturge-Weber syndrome, Capillary malformations, congenital, 1 |
| 121913495 | GNAS | NM_000516.5(GNAS):c.60 2G>A (p.Arg201His) | CGCTGCCDTGTCCTGACTTCTGG | McCune-Albright syndrome, Somatotroph adenoma, Sex cord-stromal tumor, Cushing syndrome |
| 137854539 | GNAS | NM_001077488.3(GNAS):c. 347C>T (p.Pro16Leu) | CCATGAGCAACCTGGTGCYCCCC | Pseudohypoparathyroidism type 1A, Pseudopseudohypoparathyroidism |
| 121908625 | GNE | NM_001128227.2(GNE):c. 1820G>A (p.Gly607Glu) | GATGRGCCTGATTGTTCCTGTGG | Inclusion body myopathy 2 |
| 62541771 | GNE | NM_001128227.2(GNE):c. 1985C>T (p.Ala662Val) | GTTTCRCAGCTTGGATGAGATGG | Inclusion body myopathy 2, Nonaka myopathy |
| 121434440 | GNPAT | NM_014236.3(GNPAT):c.6 31C>T (p.Arg211Cys) | CCTTTTTCATGCGYGTACCTTT | Rhizomelic chondrodysplasia punctata type 2 |
| 137852885 | GNPTG | NM_032520.4(GNPTG):c.3 16G>A (p.Gly106Ser) | TCCTCRGGTGAGTGGGGCCCGGG, ATCCTCRGGTGAGTGGGGCCGGG, GATCCTCRGGTGAGTGGGGCCGG | Mucolipidosis III Gamma |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 193302848 | GNPTG | NM_032520.4(GNPTG):c.196C>T (p.Arg66Ter) | CCCGTGCATCTCTTCYGACTCTC, CCGTGCATCTCTTCYGACTCTCG | Mucolipidosis III Gamma |
| 193302854 | GNPTG | NM_032520.4(GNPTG):c.610-1G>T | CCTGCATCCTCCACCTTCAYGGC | Mucolipidosis III Gamma |
| 104893842 | GNRHR | NM_000406.2(GNRHR):c.416G>A (p.Arg139His) | ACCRCTCCCTGGCTATCACGAGG | |
| 104893847 | GNRHR | NM_000406.2(GNRHR):c.959C>T (p.Pro320Leu) | CCCATGCTTTGATCYACTTATCT | |
| 267606849 | GP1BA | NM_000173.6(GP1BA):c.1620G>A (p.Trp540Ter) | CTGRCTGCTCTTTGCCTCTGTGG | Bernard-Soulier syndrome, type A1 |
| 121908063 | GP1BA | NM_000173.6(GP1BA):c.217C>T (p.Leu73Phe) | CCTGATGCCTTACACTCGCGYTCA | Bernard-Soulier syndrome, type A2, autosomal dominant |
| 137853582 | GPI | NM_000175.3(GPI):c.475G>A (p.Gly159Ser) | TTGGCRGCTCCGACCTGGTGAGG | Hemolytic anemia, nonspherocytic, due to glucose phosphate isomerase deficiency |
| 137853585 | GPI | NM_000175.3(GPI):c.1615G>A (p.Asp539Asn) | CTCACRACGCTTCTACCAATGGG, TCTCACRACGCTTCTACCAATGG | Hemolytic anemia, nonspherocytic, due to glucose phosphate isomerase deficiency |
| 61754634 | GPI | NM_000175.3(GPI):c.671C>T (p.Thr224Met) | CCATCACGAATGCAGAGAYGGCG | Hemolytic anemia, nonspherocytic, due to glucose phosphate isomerase deficiency |
| 267606852 | GPI | NM_000175.3(GPI):c.14C>T (p.Thr5Ile) | CCCGCCATGGCGCGCTCTCAYCCG, CGGCCATGGCGCGCTCTCAYCCGG, CCATGGCCGCTCTCAYCCGGGAC | Hemolytic anemia, nonspherocytic, due to glucose phosphate isomerase deficiency |
| 58933950 | GPR143 | NM_000273.2(GPR143):c.455G>A (p.Ser152Asn) | CCATTTCCTCGGTGAATACYTCA | Ocular albinism, type I, not provided |
| 387907138 | GPR179 | NM_001004334.3(GPR179):c.598C>T (p.Arg200Ter) | CCCCTGCCCTGAAGAAGYGAGTG, CCTGCCCTGAAGAAGYGAGTGT, CCTGCCCTGAAGAAGYGAGTGTT | Congenital stationary night blindness, type 1E |
| 267606854 | GPSM2 | NM_013296.4(GPSM2):c.379C>T (p.Arg127Ter) | CCATAGTTTGTTGTCAGYGACAC | Chudley-Mccullough syndrome |
| 769967246 | GPX4 | NM_001039848.2(GPX4):c.381C>A (p.Tyr127Ter) | CCTGACGCCCGATAYGCTGAGT | Spondylometaphyseal dysplasia Sedaghatian type |
| 180177312 | GRHPR | NM_012203.1(GRHPR):c.478G>A (p.Gly160Arg) | ATCATCRGCRGGCGCATAGG | Primary hyperoxaluria, type II |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 180177314 | GRHPR | NM_012203.1(GRHPR):c.494G>A (p.Gly165Asp) | CTCTAGRCCAGGCCATTGCTCGG | Primary hyperoxaluria, type II |
| 180177322 | GRHPR | NM_012203.1(GRHPR):c.904C>T (p.Arg302Cys) | CCACCCAGAGAACCYGCAACACC | Primary hyperoxaluria, type II |
| 137852350 | GRIA3 | NM_007325.4(GRIA3):c.2497G>A (p.Gly833Arg) | ACTTGTCRGAGGTCTGGGGCTGG | Mental retardation, X-linked, syndromic, wu type |
| 397518470 | GRIN2A | NM_000833.4(GRIN2A):c.1553G>A (p.Arg518His) | TGAGGAACRTTCTGAAGTGGTGG | Focal epilepsy with speech disorder with or without mental retardation |
| 796052571 | GRIN2B | NM_000834.3(GRIN2B):c.1858G>A (p.Val620Met) | TACCTRTGCAGAACCCAAAGGGG, GTACCTRTGCAGAACCCAAAGGG, CGTACCTRTGCAGAACCCAAAGG | not provided |
| 397514556 | GRIN2B | NM_000834.3(GRIN2B):c.1658C>T (p.Pro553Leu) | CCCTTCCTCAGAGCYATTCAGCG | Mental retardation, autosomal dominant 6 |
| 63750331 | GRN | NM_002087.3(GRN):c.3G>A (p.Met1Ile) | CATRTGGACCCTGGTGAGCTGGG, CCATRTGGACCCTGGTGAGCTGG | Frontotemporal dementia, ubiquitin-positive, not provided |
| 606231221 | GRN | NM_002087.3(GRN):c.835+1G>A | GCACACAGRTACCAGAGGCAGG | Frontotemporal dementia, ubiquitin-positive |
| 63750077 | GRN | NM_002087.3(GRN):c.373C>T (p.Gln125Ter) | CCGTGGGTGCCATCYAGTGCCCT | Frontotemporal dementia, ubiquitin-positive, not provided |
| 63751294 | GRN | NM_002087.3(GRN):c.1477C>T (p.Arg493Ter) | CCTGCAACGTGAAGGCTYGATCC | Frontotemporal dementia, ubiquitin-positive, not provided |
| 193026789 | GRN | NM_002087.3(GRN):c.1212C>A (p.Cys404Ter) | CCACCACAGCACTGCTCYCCCCAGG | Frontotemporal dementia |
| 587777289 | GSC | NM_173849.2(GSC):c.400C>T (p.Gln134Ter) | CAGCATCTRGTGCCGTACCGGGG | Short stature, auditory canal atresia, mandibular hypoplasia, skeletal abnormalities |
| 121909307 | GSS | NM_000178.2(GSS):c.491G>A (p.Arg164Gln) | TGTGCACCRGTGGGTCCCCTGGG | Gluthathione synthetase deficiency |
| 121909124 | GUCA1B | NM_002098.5(GUCA1B):c.469G>A (p.Gly157Arg) | GAGAATRGAGATGGTAAGAGGG, TGAGAATRGAGATGGTAAGAGG, ATGAGAATRGAGATGGTAAGAG | Retinitis pigmentosa 48, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61750173 | GUCY2D | NM_000180.3(GUCY2D):c.2513G>A (p.Arg838His) | CCGGGAGCRCACGGAGGAGCTG G | Cone-rod dystrophy 6, not provided |
| 121918179 | GUSB | NM_000181.3(GUSB):c.1521G>A (p.Trp507Ter) | ACTCTTGRTATCACGACTACGGG, TACTCTTGRTATCACGACTACGG | Mucopolysaccharidosis type VII |
| 398123234 | GUSB | NM_000181.3(GUSB):c.1084G>A (p.Asp362Asn) | GGGCTTCRACTGGCCGCTGCTGG | Mucopolysaccharidosis type VII, not provided |
| 377519272 | GUSB | NM_000181.3(GUSB):c.1616_1653del38 (p.Ser539Argfs*8) | CCATACTCRCTCTGAATAATGGG | Mucopolysaccharidosis type VII |
| 587779400 | GUSB | NM_000181.3(GUSB):c.530C>T (p.Thr177Ile) | CCATCAACACACACTCAYCCCC | Mucopolysaccharidosis type VII |
| 121918181 | GUSB | NM_000181.3(GUSB):c.526C>T (p.Leu176Phe) | CCATCAACACACAYTCACCCCC | Mucopolysaccharidosis type VII, not provided |
| 121434584 | GYS1 | NM_002103.4(GYS1):c.1384C>T (p.Arg462Ter) | CCTGACCACCATCCCGYGAATCG | Glycogen storage disease 0, muscle |
| 121918419 | GYS2 | NM_021957.3(GYS2):c.736C>T (p.Arg246Ter) | CCACCGGTACTGCATGGAGYGAG, CCGGTACTGCATGGAGYGAGCTT | Hypoglycemia with deficiency of glycogen synthetase in the liver |
| 137853101 | HADH | NM_005327.4(HADH):c.118G>A (p.Ala40Thr) | GATGGGCRCCGGCATTGCCCAGG | Deficiency of 3-hydroxyacyl-CoA dehydrogenase |
| 137853103 | HADH | NM_005327.4(HADH):c.773C>T (p.Pro258Leu) | CCGGTYACCCCATGGCCYATTT | Hyperinsulinemic hypoglycemia, familial, 4 |
| 121913134 | HADHB | NM_000183.2(HADHB):c.1331G>A (p.Arg444Lys) | AACARATTACGGAAAGAAGGAG, GCCAACARATTACGGAAAGAAG G | Mitochondrial trifunctional protein deficiency |
| 104894695 | HAMP | NM_021175.3(HAMP):c.166C>T (p.Arg56Ter) | CCCATGTTCCAGAGGYGAAGGAG, CCATGTTCCAGAGGYGAAGGAG G | Hemochromatosis type 2B |
| 74315322 | HAX1 | NM_006118.3(HAX1):c.568C>T (p.Gln190Ter) | CCAGATCTTGATTCCYAGGTTTC | Severe congenital neutropenia 3, autosomal recessive |
| 41417548 | HBA2 | NM_000517.4(HBA2):c.314G>A (p.Cys105Tyr) | CCACTRCCTGCTGGTGACCCTGG | Hemoglobin H disease, nondeletional |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 63750783 | HBB | NM_000518.4(HBB):c.47G >A (p. Trp16Ter) | CCTGTRGGGCAAGGTGAACCTGG | beta?0? Thalassemia |
| 34999973 | HBB | NM_000518.4(HBB):c.- 140C>T | CCTCACCCTGTGGAGCCAYACCC | beta Thalassemia |
| 34883338 | HBB | NM_000518.4(HBB):c.-50- 92C>T | CCTCACCCTGTGGAGCYACACCC | |
| 35378915 | HBG1 | NM_000559.2(HBG1):c.- 170G>A | CTTRACCAATAGCCTTGACAAGG | Fetal hemoglobin quantitative trait locus 1 |
| 35983258 | HBG1 | NM_000559.2(HBG1):c.- 53-196C>T | CCTCTTGGGGGCCCCTTCYCCAC | Fetal hemoglobin quantitative trait locus 1 |
| 281860601 | HBG1 | NM_000559.2(HBG1):c.- 167C>T | CCAGCCTTGCCTTGACYAATAGC | Fetal hemoglobin quantitative trait locus 1 |
| 34474104 | HBG2 | NM_000184.2(HBG2):c.19 0C>T (p.His64Tyr) | CCCCAAAGTCAAGGCAYATGGCA, CCCAAAGTCAAGGCAYATGGCA A, CCAAAGTCAAGGCAYATGGCAA G | Cyanosis, transient neonatal |
| 35103459 | HBG2 | NM_000184.2(HBG2):c.27 7C>T (p.His93Tyr) | CCCAGCTGAGTGAACTGYACTGT, CCAGCTGAGTGAACTGYACTGTG | Cyanosis, transient neonatal |
| 587776864 | HBG2 | NM_000184.2(HBG2):c.20 2G>A (p. Val68Met) | CCAAGGAAGTCAGCAYCTTCTT, CCAAGGAAGTCAGCAYCTTCTTG | Cyanosis, transient neonatal |
| 193929392 | HCCS | NM_005333.4(HCCS):c.47 5G>A (p.Glu159Lys) | GAATAACRAGACAGGCTTGGAAG G | Microphthalmia, syndromic, 7 |
| 318240758 | HCFC1 | NM_005334.2(HCFC1):c.6 74G>A (p.Ser225Asn) | GATGARTGGCTGCAGGCTGGGGG, GGATGARTGGCTGCAGGCTGGG, GGGATGARTGGCTGCAGGCTGGG, CGGGATGARTGGCTGCAGGCTGG | Mental retardation 3, X-linked, not provided |
| 397515486 | HCFC1 | NM_005334.2(HCFC1):c.2 18C>T (p.Ala73Val) | CCAGTGGTTCATCCCAGYCGTGA | Mental retardation 3, X-linked |
| 398122909 | HDAC8 | NM_018486.2(HDAC8):c.9 58G>A (p.Gly320Arg) | ACTTGACCRGGGTCATCCTAGGG | Cornelia de Lange syndrome 5 |
| 387907052 | HEPACAM | NM_152722.4(HEPACAM) :c.292C>T (p.Arg98Cys) | CCTGACTATCGAGACYGTATCCG | Megalencephalic leukoencephalopathy with subcortical cysts 2a |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893742 | HESX1 | NM_003865.2(HESX1):c.445G>A (p.Glu149Lys) | TCTAGAGRAAGACAGAATCCAGG | Growth hormone deficiency with pituitary anomalies |
| 121907954 | HEXA | NM_000520.4(HEXA):c.805G>A (p.Gly269Ser) | ACCARGTAAGAATGATGTCTGGG, GACCAGRTAAGAATGATGTCTGG | Tay-Sachs disease, Gm2-gangliosidosis, adult |
| 121907957 | HEXA | NM_000520.4(HEXA):c.509G>A (p.Arg170Gln) | TCCTCACCRGGGCTTGCTGTTGG | Tay-Sachs disease |
| 121907980 | HEXA | NM_000520.4(HEXA):c.805+1G>A | ACCAGRTAAGAATGATGTCTGGG, GACCAGRTAAGAATGATGTCTGG | |
| 1800429 | HEXA | NM_000520.4(HEXA):c.598G>A (p.Val200Met) | GAACRTGTTCCACTGGCATCTGG | Tay-Sachs disease, B1 variant |
| 121907966 | HEXA | NM_000520.4(HEXA):c.1495C>T (p.Arg499Cys) | CCTGACATTTGCCTATGAAYGTT | Tay-Sachs disease, Gm2-gangliosidosis, adult-onset |
| 121907972 | HEXA | NM_000520.4(HEXA):c.508C>T (p.Arg170Trp) | CCCCGCTTTCCTCACYGGGGCTT, CCCGCTTTCCTCACYGGGGCTTG | Tay-Sachs disease |
| 76173977 | HEXA | NM_000520.4(HEXA):c.1073+1G>A | CCCTCCTTCCTTCCTCAYGTCTG, CCTCCTTCCTTCCTCAYGTCTGG | Tay-Sachs disease, not provided |
| 770932296 | HEXA | NM_000520.4(HEXA):c.806-7G>A | CCAGGGATACCTAAGCYAAGAGA | Tay-Sachs disease |
| 121907983 | HEXB | NM_000521.3(HEXB):c.1514G>A (p.Arg505Gln) | AGGGCCTCRGGCAAGTGCTGTTGG | Sandhoff disease, adult type |
| 121907986 | HEXB | NM_000521.3(HEXB):c.850C>T (p.Arg284Ter) | CCAGATTACCGAGGAATTYGAGTC | Sandhoff disease, Sandhoff disease, infantile |
| 1800562 | HFE | NM_000410.3(HFE):c.845G>A (p.Cys282Tyr) | ACGTRCCAGGTGGAGCACCCAGG | Hemochromatosis type 1, Microvascular complications of diabetes 7, Transferrin serum level quantitative trait locus 2, not specified, not provided |
| 587777269 | HFM1 | NM_001017975.4(HFM1):c.2206G>A (p.Gly736Ser) | CCAAGTCAAAGTAACAAACYATA | Premature ovarian failure 9 |
| 397515347 | HGD | NM_000187.3(HGD):c.16-1G>A | TACARTACATTTCTGGATTTGGG, CTACARTACATTTCTGGATTTGG | Alkaptonuria |
| 28942100 | HGD | NM_000187.3(HGD):c.688C>T (p.Pro230Ser) | CCTCGTGATTTCTTGATAYCCAT | Alkaptonuria |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398124544 | HGSNAT | NM_152419.2(HGSNAT):c. 1250+1G>A | CTACRTAAGCGAACCCCTGGGG, CCTACRTAAGCGAACCCCTGGG, CCCTACRTAAGCGAACCCCTGGG, GCCCTACRTAAGCGAACCCCTGG | not provided |
| 112029032 | HGSNAT | NM_152419.2(HGSNAT):c. 1843G>A (p.Ala615Thr) | CATCGTCRCCACTGCCCTCTGGG, ACATCGTCRCCACTGCCCTCTGG | Mucopolysaccharidosis, MPS-III-C, RETINITIS PIGMENTOSA 73 |
| 121908286 | HGSNAT | NM_152419.2(HGSNAT):c. 1553C>T (p.Ser518Phe) | CCATTACAGGGGCTTCATTYTYGT | Mucopolysaccharidosis, MPS-III-C |
| 397514493 | HINT1 | NM_005340.6(HINT1):c.27 8G>A (p.Gly93Asp) | GAATAAGGRTATCGAATGTGG | Gamstorp-Wohlfart syndrome |
| 397514492 | HINT1 | NM_005340.6(HINT1):c.18 4C>T (p.Gln62Ter) | CCCAAGAAACATATATCCYAGAT, CCAAGAAACATATATCCYAGATT | Gamstorp-Wohlfart syndrome |
| 146448211 | HLCS | NM_000411.6(HLCS):c.19 93C>T (p.Arg665Ter) | AGTATCRGTAATAAAGGGAAG G | not provided |
| 119103231 | HLCS | NM_000411.6(HLCS):c.16 48G>A (p.Val550Met) | TGGCTGTCRTGGAAGCAGTGAGG | Holocarboxylase synthetase deficiency, not provided |
| 119103229 | HLCS | NM_000411.6(HLCS):c.15 22C>T (p.Arg508Trp) | CCTGTGTTCCAGGAYGGGGAGGG | Holocarboxylase synthetase deficiency |
| 118204096 | HMBS | NM_000190.3(HMBS):c.51 8G>A (p.Arg173Gln) | CAAACACCCRGCTTCGAAGCTGG | Acute intermittent porphyria |
| 118204100 | HMBS | NM_000190.3(HMBS):c.59 3G>A (p.Trp198Ter) | TGGGCTRGCACAACCGGGTGGGG, ATGGGCTRGCACACCGGGTGGG, CATGGGCTRGCACACCGGGTGG | Acute intermittent porphyria |
| 118204103 | HMBS | NM_000190.3(HMBS):c.77 G>A (p.Arg26His) | GGTACCCCRCAAGAGCCAGGTGGG, GGGTACCCRCAAGAGCCAGGTGG | Acute intermittent porphyria |
| 118204104 | HMBS | NM_000190.3(HMBS):c.91 G>A (p.Ala31Thr) | GCAGCTTRCTCGCATACAGACGG | Acute intermittent porphyria |
| 118204110 | HMBS | NM_000190.3(HMBS):c.66 7G>A (p.Glu223Lys) | GGGGCGTGRAAGTGCGAGCCAAG G | Acute intermittent porphyria |
| 118204112 | HMBS | NM_000190.3(HMBS):c.74 8G>A (p.Glu250Lys) | TCGCTRAAAGGGCCTTCCTGAGG | Acute intermittent porphyria |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 118204113 | HMBS | NM_000190.3(HMBS):c.754G>A (p.Ala252Thr) | AAGGRCCTTCCTGAGGCACCTGG | Acute intermittent porphyria |
| 118204116 | HMBS | NM_000190.3(HMBS):c.647G>A (p.Gly216Asp) | TGGRCCAGGTACACTTGACCAGG | Acute intermittent porphyria |
| 118204094 | HMBS | NM_000190.3(HMBS):c.346C>T (p.Arg116Trp) | CCTTCCCTCCTCCCCAGGYGGG, CCCTCCTCCCCAGGYGGGAAAA, CCTCCTCCCCAGGYGGGAAAAC | Acute intermittent porphyria |
| 118204101 | HMBS | NM_000190.3(HMBS):c.499C>T (p.Arg167Trp) | CCTTAGCAACTCTCCACAGYGGG | Acute intermittent porphyria |
| 28937320 | HMGCS2 | NM_001166107.1(HMGCS2):c.160G>A (p. Val54Met) | GGACRTGGGCATCCTGGCCCTGG | mitochondrial 3-hydroxy-3-methylglutaryl-CoA synthase deficiency |
| 137852639 | HMGCS2 | NM_001166107.1(HMGCS2):c.1373G>A (p.Arg458His) | AGCATCRCCGAAAGTATGCCCGG | mitochondrial 3-hydroxy-3-methylglutaryl-CoA synthase deficiency |
| 137853238 | HNF1A | NM_000545.6(HNF1A):c.815G>A (p.Arg272His) | GGCRCAAAGAGAAGAGCCTTCCGG | Diabetes mellitus, insulin-dependent, 20 |
| 137853241 | HNF1A | NM_000545.6(HNF1A):c.1859C>T (p.Thr620Ile) | CCACAGCGTCATCGAGAYCTTCA | Maturity-onset diabetes of the young, type 3 |
| 137853243 | HNF1A | NM_000545.6(HNF1A):c.335C>T (p.Pro112Leu) | CCCTCTCCCAGGGAGGACCYGTG, CCTCCCAGGGAGGACCYGTGG | Maturity-onset diabetes of the young, type 3 |
| 121918675 | HNF1B | NM_000458.3(HNF1B):c.494G>A (p.Arg165His) | AGCRTGCCGCTCTGTACACCTGG | Familial hypoplastic, glomerulocystic kidney |
| 137853336 | HNF4A | NM_000457.4(HNF4A):c.406C>T (p.Arg136Trp) | CCAGAATGAGCGGGACYGGATCA | Maturity-onset diabetes of the young, type 1 |
| 777046879 | HOGA1 | NM_138413.3(HOGA1):c.973G>A (p.Gly325Ser) | CAACRGCTGCTCTGAGGGCCAGG, CCAGCAACRGCTGCTCTGAGGG | Primary hyperoxaluria, type III |
| 764396564 | HOGA1 | NM_138413.3(HOGA1):c.134C>T (p.Pro45Leu) | CCCCCCTGTGACCACCCYCTTCA, CCCCTGTGACCACCCYCTTCAC, CCCTGTGACCACCCYCTTCACT, CCCTGTGACCACCCYCTTCACTG | Primary hyperoxaluria, type III |
| 104894019 | HOXA13 | NM_000522.4(HOXA13):c.1107G>A (p.Trp369Ter) | AATCTGRTTCCAGAACAGGAGGG, CAATCTGRTTCCAGAACAGGAGG | Hand foot uterus syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 550921485 | HPCA | NM_002143.2(HPCA):c.568G>A (p.Ala190Thr) | CAGCRCCTCCCAGTTCTGAGAGG | Dystonia 2, torsion, autosomal recessive |
| 398123240 | HPRT1 | NM_000194.2(HPRT1):c.384+1G>A | GAAAGRTATGTATCTTGAAAGGG, GGAAAGRTATGTATCTTGAAAGG | not provided |
| 398123241 | HPRT1 | NM_000194.2(HPRT1):c.486-1G>A | TTAACARCTTGCTGGTGAAAAGG | not provided |
| 137852506 | HPRT1 | NM_000194.2(HPRT1):c.193C>T (p.Leu65Phe) | CCATCACATTGTAGCCYTCTGTG | Partial hypoxanthine-guanine phosphoribosyltransferase deficiency |
| 281865089 | HPS1 | NM_000195.4(HPS1):c.1749G>A (p.Trp583Ter) | CCAGCTGGATCAGAGAYCAGACC | Hermansky-Pudlak syndrome 1 |
| 121908316 | HPS3 | NM_032383.4(HPS3):c.1189C>T (p.Arg397Trp) | CCTGCAGTGTTTCACTGTGYGGT | Hermansky-Pudlak syndrome 3 |
| 119471023 | HPS4 | NM_022081.5(HPS4):c.649C>T (p.Arg217Ter) | CCAAGGTCCTGCTTCACYGAACA | Hermansky-Pudlak syndrome 4 |
| 281865107 | HPS6 | NM_024747.5(HPS6):c.223C>T (p.Gln75Ter) | GGAGGGCTRGCCGGCCGGCCAGG | Hermansky-Pudlak syndrome 6 |
| 281865109 | HPS6 | NM_024747.5(HPS6):c.815C>T (p.Thr272Ile) | GCCCAGRTGTGTACAGCCAGTGG | Hermansky-Pudlak syndrome 6 |
| 281865112 | HPS6 | NM_024747.5(HPS6):c.1234C>T (p.Gln412Ter) | CCGCGCGCTRGTAGTACCCGCAGG | Hermansky-Pudlak syndrome 6 |
| 121434451 | HR | NM_005144.4(HR):c.3034G>A (p.Asp1012Asn) | GGCCRACCTGGTCAGCATCCTGG | Alopecia universalis congenita |
| 1219917780 | HSD11B2 | NM_000196.3(HSD11B2):c.622C>T (p.Arg208Cys) | CCTCTCGCCCCTGCTGYGCAGCT | Apparent mineralocorticoid excess |
| 28935475 | HSD17B10 | NM_001037811.2(HSD17B10):c.388C>T (p.Arg130Cys) | CCTTCAATGTGATCYGCCTGGTG | 2-methyl-3-hydroxybutyric aciduria |
| 119481078 | HSD17B3 | NM_000197.1(HSD17B3):c.166G>A (p.Ala56Thr) | CTGGARCAGGCGATGGAATTGGG, ACTGGARCAGGCGATGGAATTGG | Testosterone 17-beta-dehydrogenase deficiency |
| 28939085 | HSD17B3 | NM_000197.1(HSD17B3):c.695C>T (p.Ser232Leu) | CCCCATATGCTGTCTYGACTGCA, CCCATATGCTGTCTYGACTGCAA | Testosterone 17-beta-dehydrogenase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80358216 | HSD3B2 | NM_001166120.1(HSD3B2):c.512G>A (p.Trp171Ter) | AATGGGTRGAATCTAAAAATGG | 3 beta-Hydroxysteroid dehydrogenase deficiency |
| 28937569 | HSPB1 | NM_001540.3(HSPB1):c.54 5C>T (p.Pro18Leu) | CCAACGAGATCACCATCCYAGTC | Distal hereditary motor neuronopathy type 2B |
| 104894020 | HSPB1 | NM_001540.3(HSPB1):c.54 4C>T (p.Pro182Ser) | CCAACGAGATCACCATCYCAGTC | Distal hereditary motor neuronopathy type 2B |
| 29001571 | HSPB1 | NM_001540.3(HSPB1):c.37 9C>T (p.Arg127Trp) | CCGGCAAGCACGAGAGAGYGGCAG | Charcot-Marie-Tooth disease type 2F, Distal hereditary motor neuronopathy type 2B |
| 137853248 | HSPG2 | NM_005529.6(HSPG2):c.4 595G>A (p.Cys1532Tyr) | CGCTRCCCGCCAGGCTACATCGG | Schwartz Jampel syndrome type 1 |
| 587776445 | HTRA1 | NM_002775.4(HTRA1):c.8 21G>A (p.Arg274Gln) | GCTCRGCCGGGAGAGTTCGTGG | Cerebral autosomal recessive arteriopathy with subcortical infarcts and leukoencephalopathy |
| 113993969 | HTRA1 | NM_002775.4(HTRA1):c.8 89G>A (p. Val297Met) | ATCRTGAGCACCACCCAGCGAGG | Cerebral autosomal recessive arteriopathy with subcortical infarcts and leukoencephalopathy |
| 113993971 | HTRA1 | NM_002775.4(HTRA1):c.1 108C>T (p.Arg370Ter) | CCTCACGGAGTCCCATGACYGAC | Cerebral autosomal recessive arteriopathy with subcortical infarcts and leukoencephalopathy |
| 104893743 | HYAL1 | NM_153281.1(HYAL1):c.8 02G>A (p.Glu268Lys) | TGTGCCRAGGCATTCCGTGTGG | Deficiency of hyaluronoglucosaminidase |
| 373436822 | IARS2 | NM_018060.3(IARS2):c.18 21G>A (p.Trp607Ter) | TCATGRTCTTTATGTTCTTCCAGG | Leigh disease, not provided |
| 118203918 | ICK | NM_016513.4(ICK):c.815G >A (p.Arg272Gln) | GAAACRACCAACAGCTAGTCAGG | Endocrine-cerebrooosteodysplasia |
| 121913500 | IDH1 | NM_001282386.1(IDH1):c. 395G>A (p.Arg132His) | CATAGGTCRTCATGCTTATCGGG | |
| 121913502 | IDH2 | NM_002168.3(IDH2):c.419 G>A (p.Arg140Gln) | CTATCCRGAACATCCTGGGGGG, ACTATCCRGAACATCCTGGGGG, AACTATCCRGAACATCCTGGGGG | D-2-hydroxyglutaric aciduria 2 |
| 104894853 | IDS | NM_000202.6(IDS):c.998C >T (p.Ser333Leu) | CCAATCATTGCATTTACCTYGGAT | Mucopolysaccharidosis, MPS-II, not provided |
| 199422231 | IDS | NM_000202.6(IDS):c.1402 C>T (p.Arg468Trp) | CCTATAGCCAGTATCCCYGGCCT | Mucopolysaccharidosis, MPS-II |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121965019 | IDUA | NM_000203.4(IDUA):c.1205G>A (p.Trp402Ter) | GCTCTRGGCCGAAGTGTCGCAGG | Hurler syndrome, not provided |
| 121965030 | IDUA | NM_000203.4(IDUA):c.898 G>A (p.Ala300Thr) | GACCAGARCGGACCCGCTGTGGG, CGACGARCGGACCCGCTGTGTGG | |
| 121965032 | IDUA | NM_000203.4(IDUA):c.1091C>T (p.Thr364Met) | CCCCTTCGCGCAGCGCAYGCTCA, CCCTTCGCGCAGCGCAYGCTCAC, CCTTCGCGCAGCGCAYGCTCACC | Mucopolysaccharidosis, MPS-I-H/S |
| 786201032 | IFITM5 | NM_001025295.2(IFITM5): c.119C>T (p.Ser40Leu) | CCACTTGATCTGGYTGGTGTTCA | Osteogenesis imperfecta type 5 |
| 431905521 | IFT140 | NM_014714.3(IFT140):c.874G>A (p. Val292Met) | TCTCRTGATGGCCGTCGGGAGG, CCTTCTCRTGATGGCCGTCGGG, GCCTTCTCRTGATGGCCGTCGGG | Renal dysplasia, retinal pigmentary dystrophy, cerebellar ataxia and skeletal dysplasia |
| 794727473 | IFT140 | NM_014714.3(IFT140):c.3991C>T (p.Gln331Ter) | CCAGGAGACCAGGCTGGCGYAG C | Renal dysplasia, retinal pigmentary dystrophy, cerebellar ataxia and skeletal dysplasia |
| 199826737 | IFT140 | NM_014714.3(IFT140):c.1565G>A (p.Gly522Glu) | CCAAGAAGCAGGGATTCYCCTCA | |
| 201188361 | IFT140 | NM_014714.3(IFT140):c.634G>A (p.Gly212Arg) | CCAAAGTTCCTCACYGTCCATCA | Renal dysplasia, retinal pigmentary dystrophy, cerebellar ataxia and skeletal dysplasia |
| 145541911 | IFT172 | NM_015662.2(IFT172):c.886C>T (p.Arg296Trp) | GCCATCCCRCTTCCAGGCCAAGG | |
| 587777546 | IFT27 | NM_001177701.2(IFT27):c.299G>A (p.Cys100Tyr) | CCAGCCACTTGCTGYAGTTGTTG | Bardet-Biedl syndrome 19 |
| 137852667 | IGHMBP2 | NM_002180.2(IGHMBP2): c.1738G>A (p. Val580Ile) | TTCRTCAGATCCAACAGGAAAGG, TGTCCTTCRTCAGATCCAACAGG | Werdnig-Hoffmann disease, Charcot-Marie-Tooth disease |
| 74315491 | IGLL1 | NM_020070.3(IGLL1):c.64C>T (p.Gln22Ter) | CCAGGCCCCAACCTCAGGYAGCG | Agammaglobulinemia 2, autosomal recessive |
| 121917853 | IHH | NM_002181.3(IHH):c.391G>A (p.Glu131Lys) | ACCRAGGGCTGGGACGAGGACG G, GGTGACCRAGGGCTGGGACGAG G | Brachydactyly type A1 |
| 121917855 | IHH | NM_002181.3(IHH):c.298G>A (p.Asp100Asn) | CGCCRACCGCCTCATGACCCAGG | Brachydactyly type A1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267606873 | IHH | NM_002181.3(IHH):c.383G>A (p.Arg128Gln) | GCTGCRGGTGACCGAGGGCTGGG, AGTGCRGGTGACCGAGGGCTGG | Brachydactyly type A1 |
| 121917861 | IHH | NM_002181.3(IHH):c.461C>T (p.Thr154Ile) | CCGCCGGTGGACATCAYCACAT | Brachydactyly type A1 |
| 121917856 | IHH | NM_002181.3(IHH):c.137C>T (p.Pro46Leu) | CCGCCACGCAAACTCGTGCYGCT, CCACGCAAACTCGTGCYGCTCGC | Acrocapitofemoral dysplasia |
| 200296680 | IKBKB | NM_001556.2(IKBKB):c.814C>T (p.Arg272Ter) | CCACAGTGTCCTGGCTGAGYGAC | Immunodeficiency 15 |
| 137853329 | IKBKG | NM_003639.4(IKBKG):c.1207C>T (p.Gln403Ter) | CCCAAGTGCCAGTATYAGGCCCC, CCAAGTGCCAGTATYAGGCCCCT | Hypohidrotic ectodermal dysplasia with immune deficiency |
| 149491038 | IL10RA | NM_001558.3(IL10RA):c.784C>T (p.Arg262Cys) | CCTCCAGCTGTATGTGCGGYGCC, CCAGCTGTATGTGCGGYGCCGAA | |
| 137853580 | IL10RA | NM_001558.3(IL10RA):c.251C>T (p.Thr84Ile) | CCCTGTCCTATGACCTTAYCGCA, CCTGTCCTATGACCTTAYCGCAG | |
| 387906787 | IL11RA | NM_001142784.2(IL11RA):c.475C>T (p.Gln159Ter) | CCTAGGAGCTGATAGCYAGAGGT | Craniosynostosis and dental anomalies |
| 121434492 | IL12RB1 | NM_005535.2(IL12RB1):c.94C>T (p.Gln32Ter) | CCAGTGAGTGCTGTTTTYAGGAC | Immunodeficiency 30 |
| 748486078 | IL17F | NM_052872.3(IL17F):c.284C>T (p.Ser95Leu) | CTTCCRAGGGTACCGGTTGGGG, ACTTCCRAGGGTACCGGTTGG, AACTTCCRAGGGTACCGGTTGG | Candidiasis, familial, 6 |
| 387906913 | IL17RA | NM_014339.6(IL17RA):c.850C>T (p.Gln284Ter) | CCCTCTCTGCCCCGCAGATCAGC, CCTCTCTGCCCCGCAGATCAGCC | Candidiasis, familial, 5 |
| 122461161 | IL1RAPL1 | NM_014271.3(IL1RAPL1):c.1460G>A (p.Trp487Ter) | GGGCTRGAGCATCTTTGAGCTGG | Mental retardation 21, X-linked |
| 137852508 | IL2RG | NM_000206.2(IL2RG):c.865C>T (p.Arg289Ter) | CCCTGTCAGGACGATGCCCGAA, CCTGTCAGGACGATGCCCGAAT | X-linked severe combined immunodeficiency |
| 104893894 | IL7R | NM_002185.3(IL7R):c.394C>T (p.Pro132Ser) | CCAGTTAAACCTGAGGCTYCTTT | Severe combined immunodeficiency, autosomal recessive, T cell-negative, B cell-positive, NK cell-positive |
| 121912551 | IMPDH1 | NM_000883.3(IMPDH1):c.1057G>A (p.Val353Ile) | GGGGCRTCGACGTCATAGTCTTGG | Retinitis pigmentosa 10 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912553 | IMPDH1 | NM_000883.3(IMPDH1):c.568C>T (p.Arg190Trp) | CCAGCCAACGAGGTGYGGAAG G | Leber congenital amaurosis 11 |
| 267607183 | INF2 | NM_022489.3(INF2):c.653 G>A (p.Arg218Gln) | CAGCTGCRGAACGAGTTTATCGG | Focal segmental glomerulosclerosis 5 |
| 121918129 | INPP5E | NM_019892.4(INPP5E):c.1 304G>A (p.Arg435Gln) | AGCRGCTGCTGGACTACACCAGG | Familial aplasia of the vermis, Joubert syndrome 1 |
| 104894698 | INSL3 | NM_005543.3(INSL3):c.30 4C>T (p.Arg102Cys) | CCAGACCCTCTCACCATCACYGCC, CCTCTCACCATCACYGCCACCAC | Cryptorchidism, unilateral or bilateral |
| 121913139 | INSR | NM_000208.2(INSR):c.348 1G>A (p.Ala1161Thr) | CCTGRCAGCGAGAAACTGCATGG | Insulin resistance, Insulin-resistant diabetes mellitus AND acanthosis nigricans |
| 121913146 | INSR | NM_000208.2(INSR):c.479 G>A (p.Trp160Ter) | TATCGACTRGTCCCGTATCCTGG | Insulin-resistant diabetes mellitus AND acanthosis nigricans |
| 121913150 | INSR | NM_000208.2(INSR):c.357 2G>A (p.Arg191Gln) | TACTACCRGAAAGGGGGCAAGG G, TTACTACCRGAAAGGGGGCAAGG | Diabetes mellitus type 2 |
| 121913156 | INSR | NM_000208.2(INSR):c.360 2G>A (p.Arg1201Gln) | CCCTGTACRGTGGATGGCACCGG | Insulin-resistant diabetes mellitus AND acanthosis nigricans, Hyperinsulinemic hypoglycemia familial 5 |
| 1799816 | INSR | NM_000208.2(INSR):c.303 4G>A (p. Val1012Met) | GTACRTGCCGACGAGTGGGAGG, TGTGTACRTGCCGACGAGTGGG, CTGTGTACRTGCCGACGAGTGG | Diabetes mellitus type 2, not specified |
| 755549444 | INVS | NM_014425.3(INVS):c.250 9C>T (p.Gln837Ter) | CCAAGAAACAAAGTGACAYAAG C | Infantile nephronophthisis |
| 121918244 | IQCB1 | NM_001023570.2(IQCB1): c.1381C>T (p.Arg461Ter) | CCGAGTTGAACTGAAGAAAYGA G | Senior-Loken syndrome 5, not provided |
| 727503968 | IQCB1 | NM_001023570.2(IQCB1): c.1090C>T (p.Arg364Ter) | CCATGAGACTTTCYGAGAATTG | Senior-Loken syndrome 5, not provided |
| 587777261 | IQSEC2 | NM_001111125.2(IQSEC2): c.2563C>T (p.Arg855Ter) | GATGAGTCRCTCCACTTTCTGGG | Mental retardation, X-linked, nonspecific |
| 267607186 | IQSEC2 | NM_001111125.2(IQSEC2): c.2587C>T (p.Arg863Trp) | CCTCCTGCCCTGCAGCCAGYGGT, CCTGCCCTGCAGCCAGYGGTACT | Mental retardation, X-linked, nonspecific, not provided |
| 267607188 | IQSEC2 | NM_001111125.2(IQSEC2): c.1075C>T (p.Arg359Cys) | CCATCCAGACAGCCTTTCYGCCAG | Mental retardation, X-linked, nonspecific |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 377584435 | IRAK4 | NM_016123.3(IRAK4):c.34 C>T (p.Arg12Cys) | CCATCAACATATGTGYGCTGCCT | IRAK4 deficiency |
| 121434228 | IRF6 | NM_006147.3(IRF6):c.113 7G>A (p.Trp379Ter) | ATGRCCAGATGGGAAACCATTGG | Van der Woude syndrome |
| 397515434 | IRF6 | NM_006147.3(IRF6):c.145 C>T (p.Gln49Ter) | CCACCCGGCATAGCCCTYAACAA, CCCGGCATAGCCCTYAACAAGAA | Van der Woude syndrome |
| 28942093 | IRF6 | NM_006147.3(IRF6):c.5C>T (p.Ala2Val) | CCCCCCAGATCATGGYCCTCCA, CCCCCAGATCATGGYCCTCCAC, CCCCAGATCATGGYCCTCCACC | Van der Woude syndrome |
| 121434230 | IRF6 | NM_006147.3(IRF6):c.118 6C>T (p.Pro396Ser) | CCTGAACAGGTCATTYCAGTAGT | Van der Woude syndrome |
| 387906968 | IRF6 | NM_006147.3(IRF6):c.127 1C>T (p.Ser424Leu) | CCGCCTGCAGATCTYAACCCCAG | Popliteal pterygium syndrome |
| 786201005 | ISG15 | NM_055101.3(ISG15):c.16 3C>T (p.Gln55Ter) | CCCAGCGGTGTGTGGCGCTGYAGG, CCGAGCGGTGTGGCCGTGYAGGA | Immunodeficiency 38 |
| 368593151 | ISPD | NM_001101426.3(ISPD):c. 802C>T (p.Arg268Ter) | CTCRTTTGTAGGTCACCTAAAGG | Congenital muscular dystrophy-dystroglycanopathy with brain and eye anomalies, type A7 |
| 137852907 | ITGA2B | NM_000419.3(ITGA2B):c. 818G>A (p.Gly273Asp) | GGCCCTGGRCGAGTTCGACGGGG | Glanzmann thrombasthenia |
| 137852906 | ITGA2B | NM_000419.3(ITGA2B):c. 1750C>T (p.Arg584Ter) | CCACCATGGCCTTCCTTYGAGTA, CCATGGCCTTCCTTYGAGTACGC | Glanzmann thrombasthenia |
| 200402328 | ITGA7 | NM_022206.2(ITGA7):c.23 57+1G>A | CCGGCCCCGCCTGGCTTAYGTGG, CCCCGCCTGGCTTAYGTGGCCAA | Congenital muscular dystrophy |
| 374664941 | ITGA8 | NM_003638.2(ITGA8):c.12 19G>A (p.Gly407Arg) | CCTGCAAAAGGCACTCYGATGGC | Renal adysplasia |
| 9983887 | ITGB2 | NM_000211.4(ITGB2):c.32 9-6C>T | GCCRGTGGGGACAGAACAAAAG G | Leukocyte adhesion deficiency type 1 |
| 137852616 | ITGB2 | NM_000211.4(ITGB2):c.85 0G>A (p.Gly284Ser) | CGACRGCCGCTGTCACCTGAGG, CAACACRGCCGCTGTCACCTGG | Leukocyte adhesion deficiency |
| 121918449 | ITGB3 | NM_000212.2(ITGB3):c.11 99G>A (p.Cys400Tyr) | TGCCACCTRCCTCAACAATGAGG | Glanzmann thrombasthenia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912466 | ITGB4 | NM_000213.3(ITGB4):c.27 92G>A (p.Gly93lAsp) | CCGGGRCATGGTGGAGTTCCAGG | Adult junctional epidermolysis bullosa |
| 80338755 | ITGB4 | NM_000213.3(ITGB4):c.18 2G>A (p.Cys61Tyr) | CCGGCGCTRCAACACCCAGGCGG | Epidermolysis bullosa with pyloric atresia |
| 121912462 | ITGB4 | NM_000213.3(ITGB4):c.16 60C>T (p.Arg554Ter) | CCCTCTCTGCAGACYGAGGACGC | Epidermolysis bullosa with pyloric atresia |
| 121908191 | ITK | NM_005546.3(ITK):c.1003 C>T (p.Arg335Trp) | CCTGGTGACTCGACTCYGGTATC | Lymphoproliferative syndrome 1 |
| 763471771 | IVD | NM_002225.3(IVD):c.793+ 1G>A | GATTCCTGRTAAGTAGCACCGGG | Isovaleryl-CoA dehydrogenase deficiency |
| 28940889 | IVD | NM_002225.3(IVD):c.941C >T (p.Ala314Val) | CCTGCACGTGAGGGAAGYCTTTG | Isovaleryl-CoA dehydrogenase deficiency, not provided |
| 28939668 | JAG1 | NM_000214.2(JAG1):c.821 G>A (p.Gly274Asp) | ACGRCATCTGTAATGAGCCCTGG | Tetralogy of Fallot |
| 121918350 | JAG1 | NM_000214.2(JAG1):c.550 C>T (p.Arg184Cys) | CCACTTTGAGTATCAGATCYGCG | Alagille syndrome 1 |
| 587777727 | JAGN1 | NM_032492.3(JAGN1):c.3 G>A (p.MetIle) | GGCACAATRGCGTCTCGAGCAGG | Severe congenital neutropenia, Severe congenital neutropenia 6, autosomal recessive |
| 137852626 | JAK3 | NM_000215.3(JAK3):c.133 3C>T (p.Arg445Ter) | CCTTCTGGTTGGCCTCAGCYGAC | Severe combined immunodeficiency, autosomal recessive, T cell-negative, B cell-positive, NK cell-negative |
| 796052595 | KANSL1 | NM_001193466.1(KANSL 1):c.2203+1G>A | CCARTAAGTGTCAGGGAGCCGGG, GCCARTAAGTGTCAGGGAGCCGG | not provided |
| 397514746 | KARS | NM_001130089.1(KARS):c. 1129G>A (p.Asp377Asn) | TCACRATCTCATGGAAATCACGG | Deafness, autosomal recessive 89 |
| 730880257 | KATNB1 | NM_005886.2(KATNB1):c. 1604C>T (p.Ser535Leu) | CCATCAACGACCTGTYGGTGGTG | Lissencephaly 6, with microcephaly |
| 786205232 | KCNA2 | NM_004974.3(KCNA2):c.8 90G>A (p.Arg297Gln) | TCCRGTTGGTAAGAGTCTTTAGG | EPILEPTIC ENCEPHALOPATHY, EARLY INFANTILE, 32 |
| 121908593 | KCNA5 | NM_022234.3(KCNA5):c.1 828G>A (p.Glu610Lys) | CCGGRAAACAGATTTGTGAAAGG | Atrial fibrillation, familial, 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 1805128 | KCNE1 | NM_000219.5(KCNE1):c.253G>A (p.Asp85Asn) | GTCCRATGCCTGGCAAGAGAAGG | Long QT syndrome, Long QT syndrome 5, acquired, susceptibility to, Long QT syndrome 2/5, not specified, not provided |
| 199473360 | KCNE1 | NM_000219.5(KCNE1):c.247G>A (p.Glu83Lys) | TCTACATCRAGTCCGATGCCTGG | Congenital long QT syndrome |
| 199473644 | KCNE1 | NM_000219.5(KCNE1):c.163G>A (p.Gly55Ser) | TTCTTCRGCTTCTTCACCCTGGG, ATTCTTCRGCTTCTTCACCCTGG | Congenital long QT syndrome, not specified |
| 79654911 | KCNE1 | NM_000219.5(KCNE1):c.200G>A (p.Arg67His) | CCAGCTTCTTGGAGYGGATGTAG | Long QT syndrome, Congenital long QT syndrome |
| 74315446 | KCNE1 | NM_000219.5(KCNE1):c.221C>T (p.Ser74Leu) | CCAAGAAGCTGGAGCACTYGAAC | Long QT syndrome 5, Congenital long QT syndrome |
| 28933384 | KCNE1 | NM_000219.5(KCNE1):c.20C>T (p.Thr7Ile) | CCTGTCTAACACCAYAGCGGTGA | Jervell and Lange-Nielsen syndrome 2, Congenital long QT syndrome |
| 199473367 | KCNE2 | NM_172201.1(KCNE2):c.347C>T (p.Ala116Val) | CCATGAGAACATTGGTGYGGCTG | Acquired long QT syndrome |
| 199473648 | KCNE2 | NM_172201.1(KCNE2):c.29C>T (p.Thr10Met) | CCAATTTCACACAGAYGCTGGAA | Long QT syndrome, Congenital long QT syndrome, Cardiac arrhythmia |
| 730882174 | KCNH1 | NM_002238.3(KCNH1):c.1042G>A (p.Gly348Arg) | TGAATATRGAGCTGCTGTGCTGG | Zimmermann-Laband syndrome |
| 794728397 | KCNH2 | NM_000238.3(KCNH2):c.2770G>A (p.Gly924Arg) | CCGGCCGRGGGGCCGTGGGGG, GCCGGCCGRGGGGGCCGTGGGG | Cardiac arrhythmia |
| 794728401 | KCNH2 | NM_000238.3(KCNH2):c.3002G>A (p.Trp1001Ter) | AGCTTCTRGGGGACAGTCCGGG, CAGCTTCTRGGGGACAGTCGGG | Cardiac arrhythmia |
| 794728478 | KCNH2 | NM_000238.3(KCNH2):c.1129-1G>A | CGGGTGCARGTCCTGTCCCTGGG | Cardiac arrhythmia |
| 794728487 | KCNH2 | NM_000238.3(KCNH2):c.1945+1G>A | GCTRTGAGTGTGCCCAGGGGCGG, TTGGCTRTGAGTGTGCCCAGGGG, ATTGGCTRTGAGTGTGCCCAGGG, CATTGGCTRTGAGTGTGCCCAGG | Cardiac arrhythmia |
| 141401803 | KCNH2 | NM_000238.3(KCNH2):c.2860C>T (p.Arg954Cys) | GGCRGAGGGGGCTGAGCTGCGG | Sudden infant death syndrome, Cardiac arrhythmia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199472880 | KCNH2 | NM_000238.3(KCNH2):c.8 65G>A (p.Glu289Lys) | CATCRAGGCCATGCGCGCCGGGG, ACATCRAGGCCATGCGCGCCGGG, GACATCRAGGCCATGCGCGCCGG | Congenital long QT syndrome |
| 199472937 | KCNH2 | NM_000238.3(KCNH2):c.1 811G>A (p.Gly604Asp) | CCTGGGCGDCCCCTCCATCAAGG | Congenital long QT syndrome |
| 199473019 | KCNH2 | NM_000238.3(KCNH2):c.3 014G>A (p.Arg1005Gln) | CAGTCRGGGCCGCCAGTACCAGG | Congenital long QT syndrome |
| 199473022 | KCNH2 | NM_000238.3(KCNH2):c.3 107G>A (p.Gly1036Asp) | CCCGGGRCGACGTGAGAGCAG G | Congenital long QT syndrome, Cardiac arrhythmia |
| 199473432 | KCNH2 | NM_000238.3(KCNH2):c.2 660G>A (p.Arg887His) | AGCRCAAGTTGTCTTCCGCAGG | Long QT syndrome, Congenital long QT syndrome |
| 199473540 | KCNH2 | NM_000238.3(KCNH2):c.2 810G>A (p.Ser937Asn) | CTCCARCCCTGAGAGCAGTGAGG | Congenital long QT syndrome, Cardiac arrhythmia |
| 199473669 | KCNH2 | NM_000238.3(KCNH2):c.2 707G>A (p.Gly903Arg) | CCARGGAGTGTCGGCCTTGGG, GCCARGGGAGTGTCGGCCTTGG | Congenital long QT syndrome, Cardiac arrhythmia |
| 199473670 | KCNH2 | NM_000238.3(KCNH2):c.2 759G>A (p.Arg920Gln) | GTAGCCRGGGCCGGCCGGGGG G, AGTAGCCRGGGCCGGCCGGGG G, GAGTAGCCRGGGCCGGCCGGG G | Congenital long QT syndrome |
| 121912509 | KCNH2 | NM_000238.3(KCNH2):c.3 003G>A (p.Trp1001Ter) | AGCTTCTGRGGGACAGTCGGGG | Long QT syndrome 2, Cardiac arrhythmia |
| 138498207 | KCNH2 | NM_000238.3(KCNH2):c.2 371C>T (p.Arg791Trp) | GTCGCCCRCAGGATCTCGATGG | Long QT syndrome, Congenital long QT syndrome, Cardiac arrhythmia |
| 7700047651 | KCNH2 | NM_000238.3(KCNH2):c.1 128G>A (p.Gln376=) | CCGGCCGCTGGGCGCCTACYTGG, CCGCTGGGCGCCTACYTGGGTGA | Long QT syndrome, Cardiac arrhythmia |
| 794728381 | KCNH2 | NM_000238.3(KCNH2):c.2 026C>T (p.Gln676Ter) | CCCGCTACCACACAYAGATGCTG | Cardiac arrhythmia |
| 794728403 | KCNH2 | NM_000238.3(KCNH2):c.3 040C>T (p.Arg1014Ter) | CCAGTACCAGGAGCTCCCTYGAT, CCTAAGATAAAGGAGYGAACCC | Cardiac arrhythmia |
| 794728364 | KCNH2 | NM_000238.3(KCNH2):c.1 096C>T (p.Arg366Ter) | A | Cardiac arrhythmia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794728481 | KCNH2 | NM_000238.3(KCNH2):c.1684C>T (p.His562Tyr) | CCTTTGCGCTCATCGCGYACTGG | Cardiac arrhythmia |
| 199472885 | KCNH2 | NM_000238.3(KCNH2):c.934C>T (p.Arg312Cys) | CCATCCACCCACTGYGCAGCGGC | Long QT syndrome, Congenital long QT syndrome, Cardiac arrhythmia |
| 199472901 | KCNH2 | NM_000238.3(KCNH2):c.1307C>T (p.Thr436Met) | CCTTCCTGCTGAAGGAGAGAYGGAA, CCTGCTGAAGGAGAYGGAAGAAG | Congenital long QT syndrome |
| 199472910 | KCNH2 | NM_000238.3(KCNH2):c.1474C>T (p.His492Tyr) | CCCCGGCCGCATCCCGTCYACT, CCCGGCCGCATCCCGTCYACTA, CCGGCCGCATCGCCGTCYACTAC | Congenital long QT syndrome |
| 199472984 | KCNH2 | NM_000238.3(KCNH2):c.2086C>T (p.Arg696Cys) | CCCCAATCCCTGCCGCCAGYGCC, CCCAATCCCTGCCGCCAGYGCCT, CCAATCCCCTGCCGCCAGYGCCTC | Congenital long QT syndrome |
| 199473021 | KCNH2 | NM_000238.3(KCNH2):c.3097C>T (p.Arg1033Trp) | CCTCTTCCAGCCCGGTCGGYGGC, CCAGCCCGGTCGGYGGCCCCGG | Congenital long QT syndrome |
| 199473035 | KCNH2 | NM_000238.3(KCNH2):c.3457C>T (p.His1153Tyr) | CCCAGCCCCTGCACAGAYACGGC, CCAGCCCCTGCACAGAYACGCT | Congenital long QT syndrome |
| 121912504 | KCNH2 | NM_000238.3(KCNH2):c.1682C>T (p.Ala561Val) | CCTTTGCGCTCATCGYGCACTGG | Long QT syndrome 2, Congenital long QT syndrome, Cardiac arrhythmia |
| 121912508 | KCNH2 | NM_000238.3(KCNH2):c.1744C>T (p.Arg582Cys) | CCACACATGGACTCAYGCATCGG | Long QT syndrome 2, Congenital long QT syndrome, Cardiac arrhythmia |
| 794728382 | KCNH2 | NM_000238.3(KCNH2):c.2104C>T (p.Gln702Ter) | CCTCGAGGAGTACTTCYAGCACG | Cardiac arrhythmia |
| 150998911 | KCNH2 | NM_000238.3(KCNH2):c.343G>A (p. Val115Met) | CCCCATCCTCGTTCTTCAYGGGC, CCCATCCTCGTTCTTCAYGGGCA, CCATCCTCGTTCTTCAYGGGCAC | Long QT syndrome 2, Congenital long QT syndrome |
| 77331749 | KCNH2 | NM_000238.3(KCNH2):c.2738C>T (p.Ala913Val) | CCTTGGGGCCGGGCCGGGYGGG G | Long QT syndrome 2, Congenital long QT syndrome, Long QT syndrome 2/9, digenic, Cardiac arrhythmia |
| 104894253 | KCNJ1 | NM_153767.3(KCNJ1):c.535G>A (p.Ala179Thr) | AACRCAGTGATCAGCAAACGG G, GAACRCAGTGATCAGCAAACGG G, AGAACRCAGTGATCAGCAAACG G | Bartter syndrome antenatal type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853067 | KCNJ10 | NM_002241.4(KCNJ10):c.595C>T (p.Arg199Ter) | CCCTGCCTCATGATCYGAGTTGC, CCTGCCTCATGATCYGAGTTGCC | SeSAME syndrome |
| 137853071 | KCNJ10 | NM_002241.4(KCNJ10):c.889C>T (p.Arg297Cys) | CCAACTGTCAGGTGYGCACTTCC | SeSAME syndrome |
| 137853074 | KCNJ10 | NM_002241.4(KCNJ10):c.1042C>T (p.Arg348Cys) | CCTCCGTGACAGCACTGTAYGCT, CCGTGACAGCACTGTAYGCTACG | Enlarged vestibular aqueduct syndrome |
| 80356615 | KCNJ11 | NM_000525.3(KCNJ11):c.158G>A (p.Gly53Asp) | GGAGCAGGRCCGCTTCCTGCAGG | Permanent neonatal diabetes mellitus, Diabetes mellitus, permanent neonatal, with neurologic features |
| 80356616 | KCNJ11 | NM_000525.3(KCNJ11):c.175G>A (p.Val59Met) | GGACRTGTTCACCACGCTGGTGG, GCAGGACRTGTTCACCACGCTGG | Permanent neonatal diabetes mellitus, Diabetes mellitus, permanent neonatal, with neurologic features, Neonatal insulin-dependent diabetes mellitus |
| 267607196 | KCNJ11 | NM_000525.3(KCNJ11):c.844G>A (p.Glu282Lys) | CCTCRAGATCATCGTCATCCTGG | Islet cell hyperplasia |
| 80356625 | KCNJ11 | NM_000525.3(KCNJ11):c.601C>T (p.Arg201Cys) | CCGCCTCTGCTTCATGCTAYGTG, CCTCTGCTTCATGCTAYGTGTGG | Permanent neonatal diabetes mellitus, Diabetes mellitus, permanent neonatal, with neurologic features, Diabetes mellitus |
| 527236152 | KCNJ18 | NM_001194958.2(KCNJ18):c.419C>T (p.Thr140Met) | CCTCTTCTCCATCGAGAYGCAGA | Thyrotoxic periodic paralysis |
| 527236157 | KCNJ18 | NM_001194958.2(KCNJ18):c.1219C>T (p.Gln407Ter) | CCGGGATGGCCTCAGCCCCYAGG | Thyrotoxic periodic paralysis |
| 527236158 | KCNJ18 | NM_001194958.2(KCNJ18):c.1061C>T (p.Thr354Met) | CCTATGAGGTGCCCTCTAYGCCC | Thyrotoxic periodic paralysis, Thyrotoxic periodic paralysis 2 |
| 104894584 | KCNJ2 | NM_000891.2(KCNJ2):c.514G>A (p.Asp172Asn) | ATCATCRATGCTTTCATCATTGG | Short QT syndrome 3, short QT syndrome |
| 104894581 | KCNJ2 | NM_000891.2(KCNJ2):c.557C>T (p.Pro186Leu) | CCAAGATGGCAAAGCYAAAGAAG | Andersen Tawil syndrome, Congenital long QT syndrome |
| 786204795 | KCNJ6 | NM_022040.4(KCNJ6):c.460G>A (p.Gly154Ser) | CACCATTRGTTATGCTACCGGG, CCACCATTRGTTATGCTACCGG | Keppen-Lubinsky syndrome |
| 121908332 | KCNK9 | NM_001282534.1(KCNK9):c.706G>A (p.Gly236Arg) | CATCRGGGCCTTCCTCAACCTGG | Birk Barel mental retardation dysmorphism syndrome |
| 794728531 | KCNQ1 | NM_000218.2(KCNQ1):c.1685+1G>A | AGGAGRTGGGCACGCGCCAAACG | Cardiac arrhythmia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794728539 | KCNQ1 | NM_000218.2(KCNQ1):c.1 794G>A (p.Lys598=) | GACAARGTAGGCTCACGCGCCGG | Cardiac arrhythmia |
| 794728553 | KCNQ1 | NM_000218.2(KCNQ1):c.3 43G>A (p.Glu115Lys) | TCCTCRAGCGTCCCACCGGCTGG | Cardiac arrhythmia |
| 794728572 | KCNQ1 | NM_000218.2(KCNQ1):c.1 176G>A (p.Trp392Ter) | CTGRAAGATCTACATCCGGAAGG, CCACCTGRAAGATCTACATCCGG | Cardiac arrhythmia |
| 17215479 | KCNQ1 | NM_000218.2(KCNQ1):c.6 43G>A (p. Val215Met) | CTGCRTGGGCTCCAAGGGCCAGG, TCCTCTGCRTGGGCTCCAAGGGG | Congenital long QT syndrome, Long QT syndrome, LQT1 subtype |
| 120074183 | KCNQ1 | NM_000218.2(KCNQ1):c.1 034G>A (p.Gly345Glu) | CCCAGGRGATTCTTGGCTCGGG, TCCAGGRGATTCTTGGCTCGG, TTCCCAGGRGATTCTTGGCTCGG | Long QT syndrome 1, Congenital long QT syndrome, Long QT syndrome, LQT1 subtype |
| 120074187 | KCNQ1 | NM_000218.2(KCNQ1):c.8 98G>A (p.Ala300Thr) | TACRCAGATGCGCTGTGGTGGG, CTACRCAGATGCGCTGTGTGGG, GCTACRCAGATGCGCTGTGTGG, GCAGCTACRCAGATGCGCTGTGG | Long QT syndrome 1, Cardiac arrhythmia, not provided |
| 120074188 | KCNQ1 | NM_000218.2(KCNQ1):c.1 573G>A (p.Ala525Thr) | TGTGRCCAAGAAGAAATTCCAGG | Congenital long QT syndrome, Cardiac arrhythmia, Long QT syndrome, LQT1 subtype |
| 199472688 | KCNQ1 | NM_000218.2(KCNQ1):c.4 36G>A (p.Glu146Lys) | CATCRAGCAGTATGCCGCCCTGG | Congenital long QT syndrome, Long QT syndrome, LQT1 subtype |
| 199472692 | KCNQ1 | NM_000218.2(KCNQ1):c.4 84G>A (p.Val162Met) | ATCRTGCTGGTGGTGTTCTTCGG | Congenital long QT syndrome, Cardiac arrhythmia |
| 199472694 | KCNQ1 | NM_000218.2(KCNQ1):c.5 14G>A (p. Val172Met) | CGGAGTACRTGGTCCGCCTCTGG | Congenital long QT syndrome |
| 199472736 | KCNQ1 | NM_000218.2(KCNQ1):c.8 75G>A (p.Gly292Asp) | GAGTCAGRCCGCGTGGAGTTCGG | Congenital long QT syndrome, Cardiac arrhythmia |
| 199472811 | KCNQ1 | NM_000218.2(KCNQ1):c.1 750G>A (p.Gly584Ser) | GATCGCRGCAGCAACACGATCGG | Sudden infant death syndrome |
| 199473464 | KCNQ1 | NM_000218.2(KCNQ1):c.8 68G>A (p.Glu290Lys) | GGTGAACRAGTCAGGCCGCGTGG | Congenital long QT syndrome, Long QT syndrome, LQT1 subtype |
| 199473482 | KCNQ1 | NM_000218.2(KCNQ1):c.1 748G>A (p.Arg583His) | GATCRCGGCAGCAACACGATCGG | Congenital long QT syndrome, Cardiac arrhythmia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 762814879 | KCNQ1 | NM_000218.2(KCNQ1):c.4 77+1G>A | GGATGRTACGTAGACATCTGAGGG, TGGATGRTACGTAGCATCTGAGG | Cardiac arrhythmia |
| 151344631 | KCNQ1 | NM_000218.2(KCNQ1):c.6 13G>A (p. Val205Met) | CATCRTGGTCGTGGCTTCCATGG | Long QT syndrome 1, Long QT syndrome, Congenital long QT syndrome, Cardiac arrhythmia, Long QT syndrome, LQT1 subtype, not provided |
| 149089817 | KCNQ1 | NM_000218.2(KCNQ1):c.1 336G>A (p.Asp446Asn) | CGTGCRACCCCCAGAGAGCGG | Cardiac arrhythmia |
| 397508070 | KCNQ1 | NM_000218.2(KCNQ1):c.1 032+1G>A | CCCAGCGRTAGGTGCCCCGTGGG, TCCCAGCGRTAGGTGCCCCGTGG | Long QT syndrome, Cardiac arrhythmia, Long QT syndrome, LQT1 subtype |
| 140452381 | KCNQ1 | NM_000218.2(KCNQ1):c.1 354C>T (p.Arg452Trp) | CCCCCAGAAGAGCGGYGGCTG G, CCCCAGAAGAGCGGYGGCTGG A, CCCCAGAAGAGCGGYGGCTGGA C | Long QT syndrome, Congenital long QT syndrome, Cardiac arrhythmia, Long QT syndrome, LQT1 subtype |
| 199472787 | KCNQ1 | NM_000218.2(KCNQ1):c.1 555C>T (p.Arg519Cys) | CCATTAAGGTCATTCGAYGCATG | Congenital long QT syndrome |
| 199473446 | KCNQ1 | NM_000218.2(KCNQ1):c.1 97C>T (p.Ser66Phe) | CCCGCGCCCCTGCGTYCCCGGC, CGCGCCCCCTGCGTYCCCGCC | Congenital long QT syndrome |
| 199473450 | KCNQ1 | NM_000218.2(KCNQ1):c.4 09C>T (p.Leu137Phe) | CCTCATCGTCCTGGTCTGCYTCA | Congenital long QT syndrome, Cardiac arrhythmia, Long QT syndrome, LQT1 subtype |
| 775479779 | KCNQ1 | NM_000218.2(KCNQ1):c.6 42C>A (p.Cys214Ter) | CCTCCATGGTGGTCCTCTGHGTG, CCATGGTGGTCCTCTGHGTGGGC | Cardiac arrhythmia |
| 397508075 | KCNQ1 | NM_000218.2(KCNQ1):c.1 075C>T (p.Gln359Ter) | CCTGAAGGTGCAGCAGAAGYAG A | Cardiac arrhythmia, Long QT syndrome, LQT1 subtype |
| 397508097 | KCNQ1 | NM_000218.2(KCNQ1):c.1 588C>T (p.Gln530Ter) | CCAAGAAGAAATTCYAGGTAAG C | Long QT syndrome, Cardiac arrhythmia |
| 796052642 | KCNQ2 | NM_172107.2(KCNQ2):c.1 009G>A (p.Ala337Thr) | CCCGGCARCAGGCCTGATCCAGG | not provided |
| 397514581 | KCNQ2 | NM_172107.2(KCNQ2):c.6 38G>A (p.Arg213Gln) | TGGACCRGCGGGAGGCACCTGG | Early infantile epileptic encephalopathy 7, not provided |
| 397514582 | KCNQ2 | NM_172107.2(KCNQ2):c.8 69G>A (p.Gly290Asp) | CTGGAACGRCAGGCTCCTTGCGG | Early infantile epileptic encephalopathy 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777219 | KCNQ2 | NM_172107.2(KCNQ2):c.794C>T (p.Ala265Val) | CATCCRCGTAGGTGTCAAAGTGG | Early infantile epileptic encephalopathy 7, not provided |
| 796052634 | KCNQ2 | NM_172107.2(KCNQ2):c.809G>A (p.Trp270Ter) | TGGTRGGGCCTGGTGAGTTGTGG | not provided |
| 118192190 | KCNQ2 | NM_172107.2(KCNQ2):c.296+1G>A | CTACGTRTGAGTGGCCGGCGGGG, CCTACGTRTGAGTGGCCGGCGGG, GCCTACGTRTGAGTGGCCGGCGG | Benign familial neonatal seizures 1 |
| 118192200 | KCNQ2 | NM_172107.2(KCNQ2):c.620G>A (p.Arg207Gln) | TGCRGATGATCCGCATGGACCGG, GATTCTGCRGATGATCCGCATGG | Benign familial neonatal seizures 1, Seizures, benign familial neonatal, 1, and/or myokymia, not provided |
| 118192216 | KCNQ2 | NM_172107.2(KCNQ2):c.998G>A (p.Arg333Gln) | AAGAGGCRGAACCCGGCAGCAG G | Benign familial neonatal seizures 1 |
| 794727740 | KCNQ2 | NM_172107.2(KCNQ2):c.793G>A (p.Ala265Thr) | TACRCGGATGCACTCTGGTGGGG, CTACRCGGATGCACTCTGGTGGG, CCTACRCGGATGCACTCTGGTGG, ACACCTACRCGGATGCACTCTGG | Benign familial neonatal seizures 1, Seizures, Early infantile epileptic encephalopathy 7, not provided |
| 118192214 | KCNQ2 | NM_172107.2(KCNQ2):c.967C>T (p.Gln323Ter) | CCCTGAAGGTTCAGGAGYAGCAC, CCTGAAGGTTCAGGAGYAGCACA | Benign familial neonatal seizures 1 |
| 118192224 | KCNQ2 | NM_172107.2(KCNQ2):c.1288C>T (p.Pro430Ser) | CCCCTGTGTGGATGCTGCYCCGG, CCCTGTGTGGATGCTGCYCCGGA, CCTGTGTGGATGCTGCYCCGAC | Benign familial neonatal seizures 1 |
| 118192236 | KCNQ2 | NM_172107.2(KCNQ2):c.1741C>T (p.Arg581Ter) | CCACCTGGACATGCTGTCCYGAA, CCTGGACATGCTGTCCYGAATTA | Benign familial neonatal seizures 1, not provided |
| 118192251 | KCNQ3 | NM_004519.3(KCNQ3):c.988C>T (p.Arg330Cys) | CCCAAAACGTGGGAAGGCYGTCT, CCAAAACGTGGGAAGGCYGTCTG | Benign familial neonatal seizures 2 |
| 28939710 | KCNQ4 | NM_004700.3(KCNQ4):c.961G>A (p.Gly321Ser) | AGGTCCRCGCTTTGCCCTGAAGG | DFNA 2 Nonsyndromic Hearing Loss |
| 80358279 | KCNQ4 | NM_004700.3(KCNQ4):c.886G>A (p.Gly296Ser) | CTGRGCAGGGTCCTGGCTGCTGG | DFNA 2 Nonsyndromic Hearing Loss |
| 397515402 | KCNT1 | NM_020822.2(KCNT1):c.1283G>A (p.Arg428Gln) | CAGCRGGTCATCTACCTCCAGGG, CCAGCRGGTCATCTACCTCCAGG | Early infantile epileptic encephalopathy 14, Epilepsy, nocturnal frontal lobe, 5 |
| 397515404 | KCNT1 | NM_020822.2(KCNT1):c.1421G>A (p.Arg474His) | CCTGCRCGCCTGGGCCGTGAAGG | Early infantile epileptic encephalopathy 14 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777264 | KCNT1 | NM_020822.2(KCNT1):c.862G>A (p.Gly288Ser) | GACCTGCRGCATCCAGCACCTGG | Early infantile epileptic encephalopathy 14 |
| 397515405 | KCNT1 | NM_020822.2(KCNT1):c.2782C>T (p.Arg928Cys) | CCCACCCTTCCAACATGYGCTTC, CCACCCTTCCAACATGYGCTTCA | Epilepsy, nocturnal frontal lobe, 5 |
| 387907302 | KCNV2 | NM_133497.3(KCNV2):c.226C>T (p.Gln76Ter) | CCTGCCAGAAGAGACYAGCAG G | Retinal cone dystrophy 3B |
| 786205860 | KCTD17 | NM_001282684.1(KCTD17):c.434G>A (p.Arg145His) | GTACCRCGTCTGCAGTGCCAGG | DYSTONIA 26, MYOCLONIC |
| 387907260 | KCTD7 | NM_153033.4(KCTD7):c.280C>T (p.Arg94Trp) | CCCCACGGACTCCGAGGGCYGGT, CCCACGGACTCCGAGGGCYGGTA, CCACGGACTCCGAGGGCYGGTAC | Epilepsy, progressive myoclonic 3 |
| 199422234 | KDM5C | NM_004187.3(KDM5C):c.2191C>T (p.Leu731Phe) | CCCAGACGGCCTTGTCTGCYTTT, CCAGACGGCCTTGTCTGCYTTTC | Mental retardation, syndromic, Claes-Jensen type, X-linked |
| 121917860 | KERA | NM_007035.3(KERA):c.520C>T (p.Gln174Ter) | CCTGACCCTTCTTGACCTAYAGA, CCCTTCTTGACCTAYAGAACAAC | Cornea plana 2 |
| 730882122 | KIF11 | NM_004523.3(KIF11):c.790-1G>A | AAATTAAARGTTGATCTTGCAGG | Microcephaly with or without chorioretinopathy, lymphedema, or mental retardation |
| 672601369 | KIF1A | NM_001244008.1(KIF1A):c.757G>A (p.Glu253Lys) | AGCRAGCGGGCTGACTCCACGGG, GAGCRAGCGGGCTGACTCCACCG | Mental retardation, autosomal dominant 9 |
| 267607200 | KIF21A | NM_001173464.1(KIF21A):c.2841G>A (p.Met947Ile) | AGATATRAATAGACTCCTCCAAGG | Fibrosis of extraocular muscles, congenital, 3b |
| 121912585 | KIF21A | NM_001173464.1(KIF21A):c.2860C>T (p.Arg954Trp) | CCTGCTTTCTCAATAGCAYGGG | Fibrosis of extraocular muscles, congenital, 1, Fibrosis of extraocular muscles, congenital, 3b |
| 387907288 | KIF5A | NM_004984.2(KIF5A):c.839G>A (p.Arg280His) | ATCRTGACAGCAAAATGACAAGG | Spastic paraplegia 10 |
| 387907289 | KIF5A | NM_004984.2(KIF5A):c.704G>A (p.Gly235Glu) | GCAGRAGTGAGAAGGTAGGGG, GGCAGRAGTGAGAAGGTAGGG, TGGCAGRAGTGAGAAGGTAGG, CTGGCAGRAGTGAGAAGGTAG G | Spastic paraplegia 10 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434444 | KIF5A | NM_004984.2(KIF5A):c.10 82C>T (p.Ala361Val) | CCCAGAAGGAGACGATTGYGAA G, CCAGAAGGAGACGATTGYGAAG C | Spastic paraplegia 10 |
| 794727316 | KIF7 | NM_198525.2(KIF7):c.61C >T (p.Arg21Ter) | CCCAGTGCGCGGTTGCCCTGYGAG, CCAGTGCGGGTTGCCCTGYGAGT | Acrocallosal syndrome, Schinzel type |
| 104894701 | KISS1R | NM_032551.4(KISS1R):c.9 91C>T (p.Arg331Ter) | CCTGGGCTCCACTTCYGACAGG | |
| 794726675 | KIT | NM_000222.2(KIT):c.1879 +1G>A | CTCAAGCRTAAGTTCCTGTATGG | Partial albinism |
| 121913680 | KIT | NM_000222.2(KIT):c.1747 G>A (p.Glu583Lys) | AATGRAGTTTCCAGAAACAGG | Partial albinism |
| 370756367 | KLHL10 | NM_152467.3(KLHL10):c. 937G>A (p.Ala313Thr) | TGACRCTCGGGCAGACAGATGGG, ATGACRCTCGGGCAGACAGATGG | Spermatogenic failure 11 |
| 199469643 | KLHL3 | NM_017415.2(KLHL3):c.1 292G>A (p.Arg431Gln) | CGGCRGAGCAGTGTGGGTGTGGG, GCGCRGAGCAGTGTGGGTGTGG | Pseudohypoaldosteronism, type 2 |
| 199469628 | KLHL3 | NM_017415.2(KLHL3):c.1 019C>T (p.Ala340Val) | CCTTCCAGAAGATGCAGAGAGYAGG, CCAGAAGATGCAGAGYAGGTGAG | Pseudohypoaldosteronism, type 2 |
| 730882260 | KLHL41 | NM_066063.2(KLHL41):c. 1238C>T (p.Ser413Leu) | CCTTCAAACAGAGAGGCTTYGCTGG | Nemaline myopathy 9 |
| 104894704 | KLK4 | NM_004917.4(KLK4):c.45 8G>A (p.Trp153Ter) | GGCTRGGGTCTGCTCGGCGAACGG | Amelogenesis imperfecta, hypomaturation type, IIA1 |
| 794727420 | KMT2D | NM_003482.3(KMT2D):c.5 677C>T (p.Gln1893Ter) | CCAAGGACCTGCAGYAGCTCTTC | Kabuki make-up syndrome |
| 794727549 | KMT2D | NM_003482.3(KMT2D):c.7 903C>T (p.Arg2635Ter) | CCCATGGAGCCTCACAGYGATCA, CCATGGAGCCTCACAGYGATCAG | Kabuki make-up syndrome |
| 587783685 | KMT2D | NM_003482.3(KMT2D):c.1 2592C>T (p.Arg4198Ter) | CCTACGGTGGGTCAGCTTYGAGC | Kabuki make-up syndrome |
| 587783699 | KMT2D | NM_003482.3(KMT2D):c.1 5943C>T (p.Gln5315Ter) | CCCGGGTGGAGAGCTGTYAAA A, CCGGGTGGAGAGCTGTYAAAA C | Kabuki make-up syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587783711 | KMT2D | NM_003482.3(KMT2D):c.3121C>T (p.Gln1041Ter) | CCAAAACTCCCCTCCTTCCYAGT | Kabuki make-up syndrome |
| 398123704 | KMT2D | NM_003482.3(KMT2D):c.1149C>T (p.Gln317Ter) | CCTGATTCAAGGCTTTTAYAGGA | Kabuki make-up syndrome, not provided |
| 398123708 | KMT2D | NM_003482.3(KMT2D):c.11692C>T (p.Gln3898Ter) | CCCATGGGCTCTTTAYAGCAGCT, CCATGGGCTCTTTAYAGCAGCTT | Kabuki make-up syndrome, not provided |
| 398123711 | KMT2D | NM_003482.3(KMT2D):c.12406C>T (p.Gln4136Ter) | CCCCACCTGCTGGCTYAGCCCTC, CCCACCTGCTGGCTYAGCCCTCT | Kabuki make-up syndrome, not provided |
| 398123721 | KMT2D | NM_003482.3(KMT2D):c.14710C>T (p.Arg4904Ter) | CCAATCTGGATGTGYGACAGCTC | Kabuki make-up syndrome, not provided |
| 398123757 | KMT2D | NM_003482.3(KMT2D):c.7066C>T (p.Gln2356Ter) | CCAGGAGCCACCCCCTGCCYAGG | Kabuki make-up syndrome, not provided |
| 59977263 | KRT17 | NM_000422.2(KRT17):c.304G>A (p.Val102Met) | CAAGRTGCGTGCCCTGGAGGAGG, GGACAAGRTGCGTGCCCTGGAGG | Pachyonychia congenita type 2, not provided |
| 137852629 | KRT2 | NM_000423.2(KRT2):c.1459G>A (p.Glu487Lys) | AGGGCRAGGAGTGCAGGTGAGG, GAGGGCRAGGAGTGCAGGTGAG G | Ichthyosis bullosa of Siemens, Ichthyosis exfoliativa, not provided |
| 121912476 | KRT5 | NM_000424.3(KRT5):c.1252G>A (p.Glu418Lys) | TGCCCRAGCAGCGTGGGGAGCTGG | Epidermolysis bullosa simplex, autosomal recessive, not provided |
| 57499817 | KRT5 | NM_000424.3(KRT5):c.74C>T (p.Pro25Leu) | CCGCTCTGCCATCACCCYGTCT, CCTCTGCCATCACCCYGTCTGTC | Epidermolysis bullosa simplex with mottled pigmentation, not provided |
| 60554162 | KRT6A | NM_005554.3(KRT6A):c.1414G>A (p.Glu472Lys) | GGAGGGTRAGGAGTGCAGGTGG, TGGAGGGTRAGGAGTGCAGGTG G | PC-K6a, not provided |
| 60627726 | KRT6B | NM_005555.3(KRT6B):c.1414G>A (p.Glu472Lys) | GGAGGGCRAGGAGTGCAGGTGG, TGGAGGGCRAGGAGTGCAGGTG G | Pachyonychia congenita 4, not provided |
| 587777292 | KRT6C | NM_173086.4(KRT6C):c.1414G>A (p.Glu472Lys) | CCTACCTGCACTCCTYGCCCTCC | Palmoplantar keratoderma, nonepidermolytic, focal or diffuse |
| 57802288 | KRT83 | NM_022282.3(KRT83):c.1219G>A (p.Glu407Lys) | ATATCRAGATCGCCACCTACAGG | Beaded hair, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 57019720 | KRT9 | NM_000226.3(KRT9):c.511 G>A (p.Val171Met) | TAAGRTGCAGGCTCTAGAGGAGG, GGATAAGRTGCAGGCTCTAGAGG | Epidermolytic palmoplantar keratoderma, not provided |
| 137852519 | L1CAM | NM_000425.4(L1CAM):c.1 792G>A (p.Asp598Asn) | ACTGRATGTGGTGGAGAGTAGGG, AACTGRATGTGGTGGAGAGTAGG | Spastic paraplegia 1 |
| 137852524 | L1CAM | NM_000425.4(L1CAM):c.1 108G>A (p.Gly370Arg) | ATCAACRGGATCCCTGTGGAGGG, AATCAACRGGATCCCTGTGGAGG | Spastic paraplegia 1 |
| 137852525 | L1CAM | NM_000425.4(L1CAM):c.2 254G>A (p.Val752Met) | CGCRTGCAGTGGCGCCCTCAGGG, CCGRTGCAGTGGCGCCCCTCAGG | |
| 118204021 | L2HGDH | NM_024884.2(L2HGDH):c. 164G>A (p.Gly55Asp) | TCGTTGRTGCGCGAATTGTGGGG, ATCGTTGRTGCGGAATTGTGGG, CATCGTTGRTGRTGGCCGAATTGTGG | L-2-hydroxyglutaric aciduria |
| 121913574 | LAMA2 | NM_000426.3(LAMA2):c.1 580G>A (p.Cys527Tyr) | ACAGARTCAGAGTTCCTACTGG | Congenital muscular dystrophy due to partial LAMA2 deficiency, not provided |
| 398123367 | LAMA2 | NM_000426.3(LAMA2):c.1 12+1G>A | AAGAGRTACAGTCGAGGCATGG, AAAGAGRTACAGTCGAGGCATG G | Merosin deficient congenital muscular dystrophy, not provided |
| 9492297 | LAMA2 | NM_000426.3(LAMA2):c.2 750-1G>C | GCARCCTGCTGCTGTAATGCCGG | Merosin deficient congenital muscular dystrophy, not provided |
| 398123391 | LAMA2 | NM_000426.3(LAMA2):c.9 212-1G>A | TCARATGACCTCAAGCAGTTTGG | Merosin deficient congenital muscular dystrophy, not provided |
| 121913571 | LAMA2 | NM_000426.3(LAMA2):c.9 253C>T (p.Arg3085Ter) | CCAGTATTCCGTTCYGAGGTTGC | Merosin deficient congenital muscular dystrophy |
| 121913572 | LAMA2 | NM_000426.3(LAMA2):c.7 732C>T (p.Arg2578Ter) | CCACCTAGGAGAAAAYGAAGGC A | Merosin deficient congenital muscular dystrophy, not provided |
| 727502851 | LAMA2 | NM_000426.3(LAMA2):c.7 888C>T (p.Arg2630Ter) | CCGTTCATGTAGAGYGAACTAGA | Congenital muscular dystrophy |
| 398123373 | LAMA2 | NM_000426.3(LAMA2):c.3 976C>T (p.Arg1326Ter) | CCATAGAACTGTGACCYGAGAAG | Merosin deficient congenital muscular dystrophy, not provided |
| 398123378 | LAMA2 | NM_000426.3(LAMA2):c.5 914C>T (p.Gln1972Ter) | CCAAAGGCTGTCTTYAGAAAAGC | Merosin deficient congenital muscular dystrophy, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137852757 | LAMA3 | NM_198129.2(LAMA3):c.6 808C>T (p.Arg2270Ter) | CCAATCTCACAACTCTCYGAGAT | Junctional epidermolysis bullosa gravis of Herlitz |
| 137852758 | LAMA3 | NM_198129.2(LAMA3):c.8 962C>T (p.Gln2988Ter) | CCAATCATGAGCCCTCYAGTTT | Adult junctional epidermolysis bullosa |
| 730880125 | LAMB2 | NM_002292.3(LAMB2):c.2 890C>T (p.Arg964Ter) | CCGTGGGCAGGGCTCYGATGTGA | Pierson syndrome |
| 267607208 | LAMB2 | NM_002292.3(LAMB2):c.4 177C>T (p.Leu1393Phe) | CCAGCGGGCACTTGGCAAGYTCT | Nephrotic syndrome, type 5, with or without ocular abnormalities |
| 121912484 | LAMB3 | NM_000228.2(LAMB3):c.1 830G>A (p.Trp610Ter) | GTGRTCAGGGCCTGGGCTGGAGG, CCTGTGRTCAGGGCCTGGGCTGG | Junctional epidermolysis bullosa gravis of Herlitz |
| 80356681 | LAMB3 | NM_000228.2(LAMB3):c.7 27C>T (p.Gln243Ter) | CCTACTATGCTGTGTCCYAGCTC | Junctional epidermolysis bullosa gravis of Herlitz |
| 121912483 | LAMB3 | NM_000228.2(LAMB3):c.4 96C>T (p.Gln166Ter) | CCGCCAGGGTCGGCCTYAGAGCT | Junctional epidermolysis bullosa gravis of Herlitz |
| 587776812 | LAMB3 | NM_000228.2(LAMB3):c.6 28+42G>A | CCAACTCTGTTTCCTTTYCCACC | Adult junctional epidermolysis bullosa |
| 387906887 | LAMC3 | NM_066059.3(LAMC3):c.1 156C>T (p.Gln386Ter) | CCAGCCCTGTGACTGCYAGTCGG | Cortical malformations, occipital |
| 104894858 | LAMP2 | NM_002294.2(LAMP2):c.9 28G>A (p. Val310Ile) | GGCTCCRGTAAGCACAAAGCACTGG | Cardiomyopathy, Danon disease |
| 398124181 | LARGE | NM_004737.4(LARGE):c.1 102C>T (p.Gln368Ter) | CCACACCCCGCTCCCGAGYAGTGCT | not provided |
| 398123036 | LARS2 | NM_015340.3(LARS2):c.1 886C>T (p.Thr629Met) | CCTGTTYCATCCAAAAAYGAAAGA | Perrault syndrome 4 |
| 121908050 | LCAT | NM_000229.1(LCAT):c.44 0C>T (p.Thr147Ile) | CCCACAGGGTACCTGCACAVACT, CCACAGGGTACCTGCACAVACTG | Fish-eye disease |
| 387906300 | LCAT | NM_000229.1(LCAT):c.54 4C>T (p.Arg182Cys) | CCAGCAGGAGGAGTACTACYGCA | Norum disease |
| 45514002 | LDB3 | NM_007078.2(LDB3):c.201 7G>A (p.Asp673Asn) | TGCRATTTCCCCGTGGAGGCTGG, TGGCTGCRATTTCCCCGTGGAGG | Dilated cardiomyopathy 1C, Left ventricular noncompaction 3 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 45487699 | LDB3 | NM_007078.2(LDB3):c.566 C>T (p.Ser189Leu) | CCAAAAGCCCTGCCGGGCTYGAG | Dilated cardiomyopathy 1C, not specified, not provided, Familial hypertrophic cardiomyopathy 24 |
| 121908335 | LDB3 | NM_001080116.1(LDB3):c.802C>T (p.Arg268Cys) | CCCACGTTTTGCCAAATTGYGCA, CCACGTTTTGCCAAATTGYGCAA | Myofibrillar myopathy, ZASP-related, not specified |
| 121908337 | LDB3 | NM_007078.2(LDB3):c.617 C>T (p.Thr206Ile) | CCTGTACTCGGCAGAGAYCCTGA | Dilated cardiomyopathy 1C |
| 375009082 | LDLR | NM_000527.4(LDLR):c.2098G>A (p.Asp700Asn) | CTGCCCGRACGGCATGCTGCTGG | not provided |
| 121908033 | LDLR | NM_000527.4(LDLR):c.523G>A (p.Asp175Asn) | GCGAARATGGCTCGGATGAGTGG | Familial hypercholesterolemia |
| 121908037 | LDLR | NM_000527.4(LDLR):c.2531G>A (p.Gly844Asp) | GGACRCTACAGCTACCCCTCGG | Familial hypercholesterolemia |
| 768563000 | LDLR | NM_000527.4(LDLR):c.718G>A (p.Glu240Lys) | GACRAATTCCAGTGCTCTGATGG | not provided |
| 28942081 | LDLR | NM_000527.4(LDLR):c.1637G>A (p.Gly546Asp) | GAAAGGGGRCCTGAATGGTGTGG | Familial hypercholesterolemia |
| 139361635 | LDLR | NM_000527.4(LDLR):c.1024G>A (p.Asp342Asn) | CCCCRACGGCTTCCAGCTGGTGG, GTGCCCRACGGCTTCCAGCTGG | Hypercholesterolaemia, not provided |
| 387906303 | LDLR | NM_000527.4(LDLR):c.670G>A (p.Asp224Asn) | CTGCAAGRACAAATCGACGAGG | Familial hypercholesterolemia |
| 121908026 | LDLR | NM_000527.4(LDLR):c.530C>T (p.Ser177Leu) | CCCGACTGCGAAGATGGCTYGGA, CCGACTGCGAAGATGGCTYGGAT | Familial hypercholesterolemia, not provided |
| 121908044 | LDLR | NM_000527.4(LDLR):c.621C>T (p.Gly207=) | CCACTGCCTAAGTGGYGAGTGCA | Familial hypercholesterolemia |
| 752596535 | LDLR | NM_000527.4(LDLR):c.501C>A (p.Cys167Ter) | CCCCAGCTGTGGGCCTGHGACA, CCCAGCTGTGGGCCTGHGACAA, CCAGCTGTGGGCCTGHGACAAC, CCAGCTGTGGGCCTGHGACAACG | not provided |
| 121908324 | LDLRAP1 | NM_015627.2(LDLRAP1):c.65G>A (p.Trp22Ter) | AGAGCTRGGGGGGCCGGTGGCCGG | Hypercholesterolemia, autosomal recessive |
| 121909126 | LEFTY2 | NM_003240.3(LEFTY2):c.1025G>A (p.Ser342Asn) | GGTCARCCTGCCCACATGAGGG, TGGTCARCCTGCCCACATGAGG | Left-right axis malformations |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909125 | LEFTY2 | NM_003240.3(LEFTY2):c.940C>T (p.Arg314Ter) | CCATTTCTGGGGCCGYGACAGTG | Left-right axis malformations |
| 121912517 | LHB | NM_000894.2(LHB):c.167G>A (p.Gly56Asp) | TGCCCRCTACTGCCCCACCATGG | Isolated lutropin deficiency |
| 137854503 | LHX3 | NM_178138.4(LHX3):c.629C>T (p.Ala210Val) | CCAGAACCGCCGGGYCAAGGAG A | Pituitary hormone deficiency, combined 3 |
| 121912642 | LHX4 | NM_033343.3(LHX4):c.250C>T (p.Arg84Cys) | CCTGCTGCCCTGACAGGYGCTTC | Pituitary hormone deficiency, combined 4 |
| 121434560 | LIG1 | NM_000234.2(LIG1):c.1696G>A (p.Glu566Lys) | CCTGCRAATACAAATATGACGGG, ACCTGCRAATACAAATATGACGG | |
| 121434561 | LIG1 | NM_000234.2(LIG1):c.2311C>T (p.Arg771Trp) | CCTGGGCCGGGGAAGYGGGCC G | |
| 104894420 | LIG4 | NM_002312.3(LIG4):c.1406G>A (p.Gly469Glu) | GTTGAGRATATTGGGGTAAAGG | Lig4 syndrome |
| 104894419 | LIG4 | NM_002312.3(LIG4):c.2440C>T (p.Arg814Ter) | CCTCTCAGTATGTTTYGACGCCA | Lig4 syndrome |
| 116928232 | LIPA | NM_000235.3(LIPA):c.894G>A (p.Gln298=) | CCTGAAATGCTACTYGGCTCCA | Lysosomal acid lipase deficiency |
| 104894519 | LITAF | NM_004862.3(LITAF):c.334G>A (p.Gly112Ser) | ATAACGCCRTGCTCTGACCTGG | CHARCOT-MARIE-TOOTH DISEASE, DEMYELINATING, TYPE 1C |
| 587777626 | LMF1 | NM_022773.2(LMF1):c.1391G>A (p.Trp464Ter) | CCGCGAACCACATCAGCYAGTCC | Lipase deficiency combined |
| 794728589 | LMNA | NM_170707.3(LMNA):c.356+1G>A | GCGCCGRTGAGTTCGCCCAGGTGG, AAAGCGCGRTGAGTTCGCCCAGG | not provided |
| 368386019 | LMNA | NM_170707.3(LMNA):c.1931G>A (p.Arg644His) | GTCACCCRCTCCTACCTCTGG, GGTCACCCRCTCCTACCTCTGG | Congenital muscular dystrophy, not provided |
| 121912493 | LMNA | NM_170707.3(LMNA):c.1318G>A (p. Val440Met) | GCGCGRTGGCCGTGGAGGAGGTGG, CGGGCCGRTGGCCGTGGAGGAG G | Mandibuloacral dysplasia with type A lipodystrophy, atypical, not provided |
| 121912494 | LMNA | NM_170707.3(LMNA):c.1585G>A (p.Ala529Thr) | ACGRCTCTCATCAACTCCACTGG | Mandibuloacral dysostosis, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 61064130 | LMNA | NM_170707.3(LMNA):c.1822G>A (p.Gly608Ser) | GTGRCKGGACCCATCTCCTCTGG | Hutchinson-Gilford syndrome, not provided |
| 267607548 | LMNA | NM_170707.3(LMNA):c.1039G>A (p.Glu347Lys) | AGATGGCCRAGATGCGGGCAAG G | not provided |
| 267607552 | LMNA | NM_170707.3(LMNA):c.1380G>A (p.Glu460=) | ATGAGRTAGGCTCCTGCTCAGGG, AATGAGRTAGGCTCCTGCTCAGG | not provided |
| 267607571 | LMNA | NM_170707.3(LMNA):c.569G>A (p.Arg190Gln) | GGCRGGTGGATGCTGAGAACAG G | not provided |
| 267607590 | LMNA | NM_170707.3(LMNA):c.1157+1G>A | GAGRTGGGCTGGGGAGACGTCG G | not provided |
| 267607592 | LMNA | NM_170707.3(LMNA):c.1608+1G>A | GAARTAAGTAGGCCTGGGCCTGG CTGGGGAARTAAGTAGGCCTGGG | Limb-girdle muscular dystrophy, type 1B, not provided |
| 267607640 | LMNA | NM_170707.3(LMNA):c.1488+1G>A | ACGRTGAGTGGCAGGGCGCTTGG | Mandibuloacral dysostosis, not provided |
| 59270054 | LMNA | NM_170707.3(LMNA):c.244G>A (p.Glu82Lys) | CGCCTACRAGGCCGAGCTCGGGG, CCGCCTACRAGGCCGAGCTCGGG | Dilated cardiomyopathy 1A, not provided |
| 201583907 | LMNA | NM_170707.3(LMNA):c.1567G>A (p.Gly523Arg) | CTGCVGGAACAGCCTGCGTACGG | not specified, not provided |
| 28933093 | LMNA | NM_170707.3(LMNA):c.481G>A (p.Glu161Lys) | GGCRAGCTGCATGATCTGCGGGG, GGGCRAGCTGCATGATCTGCGGG, AGGGCRAGCTGCATGATCTGCGG | Dilated cardiomyopathy 1A, not provided |
| 57508089 | LMNA | NM_170707.3(LMNA):c.1146C>T (p.Gly382=) | CCGCAAGCTCTTGGAGGGYGAGG | Dilated cardiomyopathy 1A, not provided |
| 794728591 | LMNA | NM_170707.3(LMNA):c.646C>T (p.Arg216Cys) | CCAACCCTTCCAGGAGCTGYGTG, CCCTTCCAGGAGCTGYGTGAGAC, CCTTCCAGGAGCTGYGTGAGACC | not provided |
| 60890628 | LMNA | NM_170707.3(LMNA):c.1718C>T (p.Ser573Leu) | CCCACTGCAGCAGCTYGGGGGAC, CCACTGCAGCAGCTYGGGGACC | Dilated cardiomyopathy 1A, Lipodystrophy, familial partial, type 2, Mandibuloacral dysplasia with type A lipodystrophy, atypical, not specified, not provided |
| 56699480 | LMNA | NM_170707.3(LMNA):c.1477C>T (p.Gln493Ter) | CCCTGAAGGCTGGGYAGGTGGTG | Limb-girdle muscular dystrophy, type 1B, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 58672172 | LMNA | NM_170707.3(LMNA):c.11 95C>T (p.Arg399Cys) | CCCTACCTCGCAGCGCAGCYGTG, CCTACCTCGCAGCGCAGCYGTGG, CCTCGCAGCGCAGCYGTGGCCGT | Lipodystrophy, familial partial, type 2, not provided |
| 57920071 | LMNA | NM_005572.3(LMNA):c.14 44C>T (p.Arg482Trp) | CCCTTGCTGACTTACYGGTTCCC, CCTTGCTGACTTACYGGTTCCCA | Lipodystrophy, familial partial, type 2, not provided |
| 267607554 | LMNA | NM_170707.3(LMNA):c.96 1C>T (p.Arg321Ter) | CCAAGGAGGCGAAGCTTYGAGA C | Dilated cardiomyopathy 1A, not provided |
| 267607587 | LMNA | NM_170707.3(LMNA):c.73 6C>T (p.Gln246Ter) | CCGGCTGGCCGATGCGCTGYAGG | not provided |
| 57077886 | LMNA | NM_170707.3(LMNA):c.29 C>T (p.Thr10Ile) | CCGTCCCAGCGGCCGCCAYCCG, CCAGCGCGGCGCGCCAYCCGCAGC, CCAGCGCGCGCCAYCCGCAGCG | Dilated cardiomyopathy 1A, not provided |
| 61046466 | LMNA | NM_170707.3(LMNA):c.16 C>T (p.Gln6Ter) | CCATGGAGACCCCGTCCYAGCGG | Benign scapuloperoneal muscular dystrophy with cardiomyopathy, Dilated cardiomyopathy 1A, not provided |
| 121909487 | LMX1B | NM_002316.3(LMX1B):c.6 61C>T (p.Arg221Ter) | CCCGGGAGGCCCAAGYGACCCC, CCGCGGAGGCCCAAGYGACCCC G | Nail-patella syndrome |
| 121909490 | LMX1B | NM_002316.3(LMX1B):c.6 91C>T (p.Arg231Ter) | CCTCACCACCAGCAGYGAAGA G | Nail-patella syndrome |
| 121909492 | LMX1B | NM_002316.3(LMX1B):c.7 45C>T (p.Arg249Ter) | CCTCTCTTGAGCCAGGTCYGAG | Nail-patella syndrome |
| 201587138 | LOXHD1 | NM_144612.6(LOXHD1):c. 4480C>T (p.Arg1494Ter) | ATCRCTCCCCAGTGTCCCCGAGG | Deafness, autosomal recessive 77 |
| 119480072 | LPIN1 | NM_145693.2(LPIN1):c.11 62C>T (p.Arg388Ter) | CCGTTTTAGATAAAYGAAGCCGA | Myoglobinuria, acute recurrent, autosomal recessive |
| 118204070 | LPL | NM_000237.2(LPL):c.272G >A (p.Trp91Ter) | GAGTTRGGTGCCAAAACTTGTGG | Hyperlipoproteinemia, type I |
| 118204075 | LPL | NM_000237.2(LPL):c.665G >A (p.Gly222Glu) | TTGRAATCCAGAAACCAGTTGGG, ATTGRAATCCAGAAACCAGTTGG | Hyperlipoproteinemia, type I |
| 118204058 | LPL | NM_000237.2(LPL):c.397C >T (p.Gln133Ter) | CCAAACTGTGGGAYAGGATGTG | Hyperlipoproteinemia, type I |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 376610215 | LRIT3 | NM_198506.4(LRIT3):c.983G>A (p.Cys328Tyr) | CAAATRTAAGGCCAAAAATCTGG | Congenital stationary night blindness, type 1F |
| 397509378 | LRIT3 | NM_198506.4(LRIT3):c.1318C>T (p.Arg440Ter) | CCACCATGGCCAACAAGYGATCA, CCATGGCCAACAAGYGATCATTC | Congenital stationary night blindness, type 1F |
| 587776717 | LRP2 | NM_004525.2(LRP2):c.2640-1G>A | CCAGTACAATCGTGAAGCAYTAA | Donnai Barrow syndrome |
| 80338744 | LRP2 | NM_004525.2(LRP2):c.1093C>T (p.Arg365Ter) | CCAGAAGTGTGAAAGCYGACCTG | Donnai Barrow syndrome |
| 267607220 | LRP4 | NM_002334.3(LRP4):c.1585G>A (p.Asp529Asn) | GGACCRACTCAGGCACCTCCAGG | Syndactyly Cenani Lenz type |
| 267607221 | LRP4 | NM_002334.3(LRP4):c.479G>A (p.Cys160Tyr) | GAAGCTRCATTGCTGAGCATTGG | Syndactyly Cenani Lenz type |
| 746136135 | LRP4 | NM_002334.3(LRP4):c.3830G>A (p.Arg1277His) | CCAGTACCCTTGTCAGCAYGGTG | MYASTHENIC SYNDROME, CONGENITAL, 17 |
| 80358312 | LRP5 | NM_002335.3(LRP5):c.1709G>A (p.Arg570Gln) | CGAGCRGGTGCACAAGGTCAAGG | |
| 121908670 | LRP5 | NM_002335.3(LRP5):c.724G>A (p.Ala242Thr) | CTTCRCCCTGACGCTCTCCGGGG, CCTTCRCCCTGACGCTCTCCGGG, CCCTTCRCCCTGACGCTCTCCGG | Worth disease, Van Buchem disease type 2, Osteoporosis autosomal dominant type 1 |
| 397514663 | LRP5 | NM_002335.3(LRP5):c.1655C>T (p.Thr552Met) | CCGACACATTTTTGGGTTCAYGCT | Osteoporosis with pseudoglioma |
| 397514664 | LRP5 | NM_002335.3(LRP5):c.1145C>T (p.Pro382Leu) | CCATCGACTACGACCYGCTAGAG | Osteoporosis with pseudoglioma |
| 397514665 | LRP5 | NM_002335.3(LRP5):c.731C>T (p.Thr244Met) | CCCCTTCGCCCTGAYGCTCTCCG | Osteoporosis with pseudoglioma |
| 80358308 | LRP5 | NM_002335.3(LRP5):c.1330C>T (p.Arg444Cys) | CCGCATCGAGGTGACGYGCCTCA | |
| 121908663 | LRP5 | NM_002335.3(LRP5):c.2557C>T (p.Gln853Ter) | CCGGTTCGGTCTGACGYAGTACA, CCGTTCGGTCTGACGYAGTACAG | Osteoporosis with pseudoglioma |
| 397515474 | LRP6 | NM_002336.2(LRP6):c.1418G>A (p.Arg473Gln) | ATTGAGCRAGCAGTCTCTGATGG | Coronary artery disease, autosomal dominant 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853187 | LRTOMT | NM_001145308.4(LRTOMT):c.328G>A (p.Glu110Lys) | TGCRAGTACTTGAGCCACATGGG, CTGCRAGTACTTGAGCCACATGG | Deafness, autosomal recessive 63 |
| 387907175 | LTBP2 | NM_000428.2(LTBP2):c.4313G>A (p.Cys1438Tyr) | GCTRCACCCAGGGCGCTAGCTGG | Microspherophakia |
| 137854856 | LTBP2 | NM_000428.2(LTBP2):c.3529G>A (p. Val1177Met) | AGATRTGAATGAGTGCATGGGGG, CAGATRTGAATGAGTGCATGGGG, GCAGATRTGAATGAGTGCATGGG, TGCAGATRTGAATGAGTGCATGG | Weill-Marchesani syndrome 1, Weill-Marchesani syndrome 3 |
| 121918356 | LTBP2 | NM_000428.2(LTBP2):c.331C>T (p.Gln111Ter) | CCGTCCCGCGCGCAGYAGTCGCG | Glaucoma 3, primary congenital, d |
| 137854855 | LTBP2 | NM_000428.2(LTBP2):c.1642C>T (p.Arg548Ter) | CCCAGCAGCACCCAGGCCTYGAG, CCAGCAGCACCCAGGCCTYGAGG | Marfan syndrome |
| 397515430 | LTBP4 | NM_001042544.1(LTBP4):c.1453C>T (p.Arg485Ter) | CCTGGGCCAGGAGCCACCCYGAG | Cutis laxa with severe pulmonary, gastrointestinal, and urinary abnormalities |
| 587777433 | LYRM7 | NM_181705.3(LYRM7):c.73G>A (p.Asp25Asn) | AATRATGCCAGAGCATTAGAAGG | MITOCHONDRIAL COMPLEX III DEFICIENCY, NUCLEAR TYPE 8 |
| 80338652 | LYST | NM_000081.3(LYST):c.3310C>T (p.Arg1104Ter) | CCTCACTTCAAAGTATAYGACTT | Ch\xc3\xa9diak-Higashi syndrome, Chediak-Higashi syndrome, adult type |
| 587777180 | LZTR1 | NM_006767.3(LZTR1):c.1397G>A (p.Arg466Gln) | CGCRGAGCCGCTGGCTTCGCAGG | Schwannomatosis 2 |
| 587777177 | LZTR1 | NM_006767.3(LZTR1):c.365C>T (p.Ser122Leu) | CCCCCCGTTACCACCACTYGGCC, CCCCGTTACCACCACTYGGCCG, CCCGTTACCACCACTYGGCCGT, CCGTTACCACCACTYGGCCGTC, CGTTACCACCACTYGGCCCCTCG | Schwannomatosis 2 |
| 730880014 | MAFB | NM_005461.4(MAFB):c.161C>T | CCTGCAGCCAGCCGGCTYGGTGT | Multicentric osteolysis nephropathy |
| 387907007 | MAFB | NM_005461.4(MAFB):c.211C>T (p.Pro71Ser) | CCGTGCCCTCGTCGYCCAGCTTC | Multicentric osteolysis nephropathy |
| 387907008 | MAFB | NM_005461.4(MAFB):c.212C>T (p.Pro71Leu) | CCGTGCCCTCGTCGYCAGCTTC | Multicentric osteolysis nephropathy |
| 398122418 | MAGEL2 | NM_019066.4(MAGEL2):c.3124C>T (p.Gln1042Ter) | CCAAGCCAAGGTGCCTGTCYAGC, CCAAGGTGCCTGTCYAGCGCTCG | Prader-Willi-like syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906724 | MAGT1 | NM_032121.5(MAGT1):c.409C>T (p.Arg137Ter) | CCTGGCAAACTCCTGGYGATACT | Immunodeficiency, X-Linked, with magnesium defect, Epstein-Barr virus infection, and neoplasia |
| 121909494 | MAMLD1 | NM_005491.4(MAMLD1):c.808C>T (p.Gln270Ter) | CCTTCCACCAGTAAGYAGATAGT | Hypospadias 2, X-linked |
| 387906886 | MAN1B1 | NM_016219.4(MAN1B1):c.1000C>T (p.Arg334Cys) | CCTGTTTGAGAGCACGATCYGCA | Mental retardation, autosomal recessive 15 |
| 80338679 | MAN2B1 | NM_000528.3(MAN2B1):c.2165+1G>A | TGGRTGAGTGGCACAGGCTGGG, GTGGGRTGAGTGGCACAGGCTGG | Deficiency of alpha-mannosidase |
| 398123455 | MAN2B1 | NM_000528.3(MAN2B1):c.1929G>A (p.Trp643Ter) | TCCAGRTACAACGCCAGTATAGG | not provided |
| 121434332 | MAN2B1 | NM_000528.3(MAN2B1):c.1915C>T (p.Gln639Ter) | CCTGCTGCTGTTCGCYAGACCT | Deficiency of alpha-mannosidase |
| 730880504 | MAP2K1 | NM_002755.3(MAP2K1):c.412G>A (p.Glu138Lys) | TGGCRAGATCAGTATCTGCATGG | Rasopathy |
| 63750635 | MAPT | NM_016835.4(MAPT):c.1910C>T (p.Ser637Phe) | CCTGAGCAAGGTGACCTYCAAGT | Pick disease, not provided |
| 587777718 | MARS | NM_004990.3(MARS):c.1852C>T (p.Arg618Cys) | CCCTGCTGACATCTGGYGCTTCT, CCTGCTGACATCTGGYGCTTCTA | Charcot-Marie-Tooth disease, CHARCOT-MARIE-TOOTH DISEASE, AXONAL, TYPE 2U |
| 794726870 | MARS2 | NM_138395.3(MARS2):c.424C>T (p.Arg142Trp) | CCGCACCACCGGAGGCCYGGCACC | COMBINED OXIDATIVE PHOSPHORYLATION DEFICIENCY 25 |
| 794726869 | MARS2 | NM_138395.3(MARS2):c.550C>T (p.Gln184Ter) | CCTGAGGCCAAGGTCACCYAGCA | COMBINED OXIDATIVE PHOSPHORYLATION DEFICIENCY 25 |
| 118203957 | MARVELD2 | NM_001038603.2(MARVELD2):c.1498C>T (p.Arg500Ter) | CCACATCATTCGGAAAGCYGACA | Deafness, autosomal recessive 49 |
| 72558181 | MATIA | NM_000429.2(MAT1A):c.791G>A (p.Arg264His) | CACTGGCCRTAAGATTATTGTGG | Methionine adenosyltransferase deficiency, autosomal dominant |
| 104893640 | MATN3 | NM_002381.4(MATN3):c.209G>A (p.Arg70His) | CCTGGCCRCGCCCCGCGGTGCAGG | Multiple epiphyseal dysplasia 5, Multiple Epiphyseal Dysplasia, Dominant |
| 786203385 | MAX | NM_002382.4(MAX):c.295+1G>A | AAGRTGAGCACCCGAGCTCGTGG | Hereditary cancer-predisposing syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 1800450 | MBL2 | NM_000242.2(MBL2):c.161G>A (p.Gly54Asp) | ATGRCACCAAGGGAGAAAGGG, GATGRCACCAAGGGAGAAAAGG, TGATGRCACCAAGGGAGAAAAG | Mannose-binding protein deficiency |
| 5030737 | MBL2 | NM_000242.2(MBL2):c.154C>T (p.Arg52Cys) | CCCAGGCAAAGATGGGYGTGAT G, CCAGGCAAAGATGGGYGTGATG G | Mannose-binding protein deficiency |
| 121913557 | MC4R | NM_005912.2(MC4R):c.148G>A (p.Val50Met) | CCTGAGRTGTTTGTGACTCTGGG, TCCTGAGRTGTTTGTGACTCTGG | Obesity |
| 121913563 | MC4R | NM_005912.2(MC4R):c.523G>A (p.Ala175Thr) | TGGRCAGCTTGCACGGTTTCAGG | Obesity |
| 121913567 | MC4R | NM_005912.2(MC4R):c.656C>T (p.Ala219Val) | CCACATGTTCCTGATGGYCAGGC | Obesity |
| 199517715 | MCCC1 | NM_020166.4(MCCC1):c.137G>A (p.Gly46Glu) | CCTTGGTAATGTTTCTTYCTGTT | not provided |
| 387906286 | MCFD2 | NM_001171507.2(MCFD2):c.149+5G>A | TACRTATTCAGCCCGGGCTGTGG | Factor v and factor viii, combined deficiency of, 2 |
| 387906287 | MCFD2 | NM_001171507.2(MCFD2):c.309+1G>A | TAAGGAGRTAGGTCTGGCAGTGG | Factor v and factor viii, combined deficiency of, 2 |
| 28934906 | MECP2 | NM_004992.3(MECP2):c.473C>T (p.Thr158Met) | CCTAATGATTTTGACTTCAYGGT | Angelman syndrome, Rett disorder, Severe neonatal-onset encephalopathy with microcephaly, Autism, susceptibility to, X-linked 3, not provided |
| 61748425 | MECP2 | NM_004992.3(MECP2):c.508C>T (p.Gln170Ter) | CCCCTCCCGGCGAGAGYAGAAAC, CCCTCCCGGCGAGAGYAGAAACC, CCTCCCGGCGAGAGYAGAAACCA | Rett disorder |
| 61749729 | MECP2 | NM_004992.3(MECP2):c.622C>T (p.Gln208Ter) | CCACGTCAGAGGGTGTGYAGGTG | Rett disorder |
| 61749747 | MECP2 | NM_004992.3(MECP2):c.730C>T (p.Gln244Ter) | CCACCACATCCACCYAGGTCATG | Rett disorder, Mental retardation, X-linked, syndromic 13, not provided |
| 61753965 | MECP2 | NM_004992.3(MECP2):c.1216C>T (p.Gln406Ter) | CCAGCCCCCTGAGCCCYAGGAC | Rett disorder, Mental retardation, X-linked, syndromic 13, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515554 | MED12 | NM_005120.2(MED12):c.2873G>A (p.Gly958Glu) | CATGRGATGAACCGTCCGATGG | FG syndrome |
| 145770066 | MED25 | NM_030973.3(MED25):c.1004C>T (p.Ala335Val) | CCCCAGGACCCCCTGGCGYCCC, CCCCAGGACCCCCTGGCGYCCCC, CCCAGGACCCCCTGGCGYCCCA, CCAGGACCCCCTGGCGYCCCCAA | Charcot-Marie-Tooth disease type 2B2, Charcot-Marie-Tooth disease, not provided |
| 796052724 | MEF2C | NM_002397.4(MEF2C):c.258G>A (p.Glu86=) | TGGARGTGAGAGAGCATGCCTGG | not provided |
| 796052733 | MEF2C | NM_002397.4(MEF2C):c.766C>T (p.Arg256Ter) | CCGTAAACCAGATCTCYGAGTTC | not provided |
| 587783747 | MEF2C | NM_002397.4(MEF2C):c.565C>T (p.Arg189Ter) | CCTGGTGTAACACATYGACCTCC | Mental retardation, stereotypic movements, epilepsy, and/or cerebral malformations |
| 104895085 | MEFV | NM_000243.2(MEFV):c.1958G>A (p.Arg653His) | CCGCCRTTACTGGAGGTGGAGG, TGGCCGCCRTTACTGGGAGTGG | Familial Mediterranean fever |
| 28940578 | MEFV | NM_000243.2(MEFV):c.2082G>A (p.Met694Ile) | GATRAAGGAAAATGAGTACCAGG | Familial Mediterranean fever, Familial mediterranean fever, autosomal dominant |
| 104895105 | MEFV | NM_000243.2(MEFV):c.1432C>T (p.His478Tyr) | CCTGGAGCAGCAAGAGYATTTCT | Familial Mediterranean fever, Familial mediterranean fever, autosomal dominant |
| 104894257 | MEN1 | NM_130799.2(MEN1):c.594G>A (p.Trp198Ter) | CTGRCACGGCAAGGGCAACAG G | not provided |
| 104894264 | MEN1 | NM_000244.3(MEN1):c.1267G>A (p.Asp423Asn) | CTACVACGGCATCTGCAAATGGG, TCTACVACGGCATCTGCAAATGG | Multiple endocrine neoplasia, type 1 |
| 794728628 | MEN1 | NM_130799.2(MEN1):c.1186-1G>A | GTCCARGGCACCCAGAGCCAAGG | not provided |
| 386134249 | MEN1 | NM_000244.3(MEN1):c.1277G>A (p.Cys426Tyr) | GGCATCTRCAAATGGAGGAGG G, CGGCATCTRCAAATGGGAGGAGG | Multiple endocrine neoplasia, type 1, not provided |
| 398124437 | MEN1 | NM_130799.2(MEN1):c.912+1G>A | AAGRTGGGGCATCTAAGGAGG G, CAAGRTGGGGCATCTAAGGAG G, CCCAAGRTGGGGCATCTAAGG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28931612 | MEN1 | NM_000244.3(MEN1):c.76 G>A (p.Glu26Lys) | TGCTGCCDAGCTGGGCCGAGAGG | |
| 794728614 | MEN1 | NM_130799.2(MEN1):c.35 C>T (p.Pro12Leu) | CCCAGAAGACGCTGTTCCYGCTG, CCAGAAGACGCTGTTCCYGCTGC | not provided |
| 794728620 | MEN1 | NM_130799.2(MEN1):c.65 2C>T (p.Arg218Trp) | CCGGTGTGGCTGAGYGGGTATTG | not provided |
| 794728631 | MEN1 | NM_130799.2(MEN1):c.16 60C>T (p.Gln554Ter) | CCAGTGCTCACTTTCYAGAGTGA | not provided |
| 794728647 | MEN1 | NM_130799.2(MEN1):c.32 2C>T (p.Arg108Ter) | CCTGTCCCTCTATCCYGAGAAG | not provided |
| 794728654 | MEN1 | NM_130799.2(MEN1):c.13 24C>T (p.Gln442Ter) | CCACCTTCTTGTGYAGTCCCTA | |
| 119489105 | MERTK | NM_006343.2(MERTK):c.1 951C>T (p.Arg651Ter) | CCACCCAAATGTCATTYGACTTC | Retinitis pigmentosa 38 |
| 587777646 | METTL2 3 | NM_001080510.4(METTL 23):c.397C>T (p.Gln133Ter) | CCAATTGTGGTCTACTTATYAAG | Mental retardation, autosomal recessive 44 |
| 727502791 | MFAP5 | NM_003480.3(MFAP5):c.4 72C>T | CCGTCGCTCCAATTACTTCYGAC | Aortic aneurysm, familial thoracic 9 |
| 28940291 | MFN2 | NM_014874.3(MFN2):c.28 1G>A (p.Arg94Gln) | GGCTCRGAGGCACATGAAAGTGG | Charcot-Marie-Tooth disease, type 2A2 |
| 28940294 | MFN2 | NM_014874.3(MFN2):c.83 9G>A (p.Arg280His) | GGAGCRTTGTACCAGCTTCCTGG | Charcot-Marie-Tooth disease, type 2A2 |
| 138382758 | MFN2 | NM_014874.3(MFN2):c.14 03G>A (p.Arg468His) | CTGCACCRCCACATAGAGGAAGG | Charcot-Marie-Tooth disease, type 2A2, not specified |
| 119103266 | MFN2 | NM_014874.3(MFN2):c.61 7C>T (p.Thr206Ile) | CCCTGGTATTGATGTCAYCACAG, CCTGGTATTGATGTCAYCACAGA | Hereditary motor and sensory neuropathy with optic atrophy |
| 387906991 | MFN2 | NM_014874.3(MFN2):c.10 85C>T (p.Thr362Met) | CCAAGTTTGAGCAGCACAYGGTC | Charcot-Marie-Tooth disease, type 2A2 |
| 267607235 | MFSD8 | NM_152778.2(MFSD8):c.1 235C>T (p.Pro412Leu) | CCTGTGCCTCTACACCCYGGTG | Ceroid lipofuscinosis neuronal 7 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894446 | MGAT2 | NM_002408.3(MGAT2):c.8 69C>T (p.Ser290Phe) | CCTGAATGTGATGTTCTCTYCCT | Carbohydrate-deficient glycoprotein syndrome type II |
| 587776943 | MGME1 | NM_001310338.1(MGME1): c.456G>A (p.Trp152Ter) | GTGRAAACAGCGGATGATTCTGG | Mitochondrial DNA depletion syndrome 11 |
| 119486096 | MINPP1 | NM_004897.4(MINPP1):c. 122C>T (p.Ser41Leu) | CCGAGGGACCCGGTGGCCTYGTC | Thyroid cancer, follicular |
| 281797258 | MKKS | NM_170784.2(MKKS):c.25 0C>T (p.His84Tyr) | TGAACATRATTCTGTATGGAGG | McKusick Kaufman syndrome |
| 80358245 | MLC1 | NM_015166.3(MLC1):c.27 8C>T (p.Ser93Leu) | CCAGTGCATCCCCTYGGCAATTG | Megalencephalic leukoencephalopathy with subcortical cysts 1 |
| 121908341 | MLC1 | NM_015166.3(MLC1):c.83 9C>T (p.Ser280Leu) | CCTCTGGATATCTGTYATTCAGC | Megalencephalic leukoencephalopathy with subcortical cysts 1 |
| 63750604 | MLH1 | NM_000249.3(MLH1):c.17 90G>A (p.Trp597Ter) | AGTGGCTRGACAGAGGAAGATG G | Hereditary Nonpolyposis Colorectal Neoplasms |
| 587779021 | MLH1 | NM_000249.3(MLH1):c.54 5G>A (p.Arg182Lys) | GCARGTACAGTCCAAAATCGGG, GGCARGTACAGTCCAAAATCTGG | Hereditary Nonpolyposis Colorectal Neoplasms |
| 63749820 | MLH1 | NM_000249.3(MLH1):c.43 6C>T (p.Gln146Ter) | CCATGTGCTGGCAATYAAGGGAC | Hereditary Nonpolyposis Colorectal Neoplasms |
| 63749950 | MLH1 | NM_000249.3(MLH1):c.84 2C>T (p.Ala281 Val) | CCATAGAAACAGTGTATGYAGCC | Hereditary Nonpolyposis Colorectal Neoplasms |
| 63750192 | MLH1 | NM_000249.3(MLH1):c.16 24C>T (p.Gln542Ter) | CCTCAGTGGGCCTTGGCAYAGCA | Hereditary Nonpolyposis Colorectal Neoplasms |
| 63750726 | MLH1 | NM_000249.3(MLH1):c.19 61C>T (p.Pro654Leu) | CCCCCTTTGGAGGGACTGCYTAT, CCCCTTTGGAGGGACTGCYTATC, CCCTTTGGAGGGACTGCYTATCT, CCTTTGGAGGGACTGCYTATCTT | Hereditary Nonpolyposis Colorectal Neoplasms |
| 63751109 | MLH1 | NM_000249.3(MLH1):c.13 1C>T (p.Ser44Phe) | CCAGTTTAGATGCAAAATYCACA | Hereditary Nonpolyposis Colorectal Neoplasms, Lynch syndrome II |
| 63751153 | MLH1 | NM_000249.3(MLH1):c.12 25C>T (p.Gln409Ter) | CCCCTGTCCAGTCAGCCCYAGGC, CCCTGTCCAGTCAGCCCYAGCC, CCTGTCCAGTCAGCCCYAGGCCA | Hereditary Nonpolyposis Colorectal Neoplasms |
| 63751310 | MLH1 | NM_000249.3(MLH1):c.19 75C>T (p.Arg659Ter) | CCTATCTTCATTCTTYGACTAGC | Hereditary Nonpolyposis Colorectal Neoplasms, Hereditary cancer-predisposing syndrome, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587779058 | MLH1 | NM_000249.3(MLH1):c.982C>T (p.Gln328Ter) | CCTGGAGCGGGTGCAGYAGCACA | Hereditary Nonpolyposis Colorectal Neoplasms, Hereditary cancer-predisposing syndrome |
| 119473031 | MLPH | NM_024101.6(MLPH):c.103C>T (p.Arg35Trp) | CCGAAGGAAAGAAGAGGAAYGGC | Griscelli syndrome type 3 |
| 369296618 | MMAB | NM_052845.3(MMAB):c.700C>T (p.Gln234Ter) | CTCTTRATTCCCTCCTTCATGG | Methylmalonic aciduria cblB type, not provided |
| 756414548 | MMAB | NM_052845.3(MMAB):c.569G>A (p.Arg190His) | CCGTCTCTGGCCCGGYGGCACA | not provided |
| 796051996 | MMACHC | NM_015506.2(MMACHC):c.420G>A (p.Trp140Ter) | CATGRGGGAACCAGGTGAGAGG, CCATGRGGGAACCAGGTGAGAGG | Methylmalonic acidemia with homocystinuria, not provided |
| 796051997 | MMACHC | NM_015506.2(MMACHC):c.600G>A (p.Trp200Ter) | CTGRCGTGATTGGACTTACCGGG, ACTGRCGTGATTGGACTTACCGG | not provided |
| 121912955 | MMP2 | NM_004530.5(MMP2):c.1210G>A (p.Glu404Lys) | CACRAGTTTGGCCACGCCATGGG, CCACRAGTTTGGCCACGCCATGG | Multicentric osteolysis, nodulosis and arthropathy |
| 104893969 | MOCS1 | NM_001075098.3(MOCS1):c.956G>A (p.Arg319Gln) | GCCTGCRAATCACAGCTGATGGG, CGCCTGCRAATCACAGCTGATGG | Molybdenum cofactor deficiency, complementation group A |
| 104893970 | MOCS1 | NM_001075098.3(MOCS1):c.217C>T (p.Arg73Trp) | CCGGCAGCACACAGCTACCTGYGGA | Molybdenum cofactor deficiency, complementation group A |
| 387907237 | MPC1 | NM_016098.3(MPC1):c.289C>T (p.Arg97Trp) | CCAGCTCATCCAGGAGGGYGGC | Mitochondrial pyruvate carrier deficiency |
| 104894489 | MPI | NM_002435.2(MPI):c.656G>A (p.Arg219Gln) | AAGCRGATCTCCAGCAAGGTGG, GTGAAGCRGATCTCCCAGCAAGG | Congenital disorder of glycosylation type 1B |
| 104894494 | MPI | NM_002435.2(MPI):c.305C>T (p.Ser102Leu) | CCTCTTCAAAGTGCTCTYAGTTG | Congenital disorder of glycosylation type 1B |
| 121913611 | MPL | NM_005373.2(MPL):c.769C>T (p.Arg257Cys) | CCTACTGGCTGCAGCTGYGCAGC | Congenital amegakaryocytic thrombocytopenia |
| 28730837 | MPO | NM_000250.1(MPO):c.995C>T (p.Ala332Val) | CCGCAACCAGATCAACGYGCTCA | Myeloperoxidase deficiency |
| 121909721 | MPV17 | NM_002437.4(MPV17):c.149G>A (p.Arg50Gln) | GAGAGGCCRGACTCTGACCATGG | Navajo neurohepatopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909724 | MPV17 | NM_002437.4(MPV17):c.359G>A (p.Trp120Ter) | CAACTRGGCCAAACTACAGCGGG, ACAACTRGGCCAAACTACAGCGG | Navajo neurohepatopathy |
| 267607261 | MPV17 | NM_002437.4(MPV17):c.206G>A (p.Trp69Ter) | GCTRGTACAAGGTTTTGGATCGG, AGGAGGCTRGTACAAGGTTTTGG | Navajo neurohepatopathy |
| 267607258 | MPV17 | NM_002437.4(MPV17):c.293C>T (p.Pro98Leu) | CCCTAGGGGGGCTTTGCCCYGTG, CCTAGGGGGGCTTTGCCCYGTGT | Navajo neurohepatopathy, not provided |
| 121913588 | MPZ | NM_000530.6(MPZ):c.409G>A (p.Gly137Ser) | CATAGTGRGCAAGACCCTCTCAGG | Charcot-Marie-Tooth disease type 1B |
| 121913600 | MPZ | NM_000530.6(MPZ):c.308G>A (p.Gly103Glu) | GGTAGRGGACCCTCCGTGGAAGG | Charcot-Marie-Tooth disease type 1B |
| 121913598 | MPZ | NM_000530.6(MPZ):c.131C>T (p.Ser44Phe) | CCATGGTGCTGTGGGCTYCCGGG | Charcot-Marie-Tooth disease type 2I, Charcot-Marie-Tooth disease type 1B |
| 137852761 | MRE11A | NM_005591.3(MRE11A):c.1714C>T (p.Arg572Ter) | CCAACAAAGGAAGAGGCYGAGG A | Hereditary cancer-predisposing syndrome, Ataxia-telangiectasia-like disorder |
| 63750396 | MSH2 | NM_000251.2(MSH2):c.1035G>A (p.Trp345Ter) | GTGRATTAAGCAGCCTCTCATGG | Hereditary Nonpolyposis Colorectal Neoplasms, not provided |
| 63750466 | MSH2 | NM_000251.2(MSH2):c.4G>A (p.Ala2Thr) | CGACATGRCCGTGCAGCCGAAGG | Hereditary Nonpolyposis Colorectal Neoplasms, Hereditary cancer-predisposing syndrome, not specified, not provided |
| 63750624 | MSH2 | NM_000251.2(MSH2):c.484G>A (p.Gly162Arg) | ACAGGTTRGAGTTGGGTATGTGG | Hereditary Nonpolyposis Colorectal Neoplasms |
| 63749917 | MSH2 | NM_000251.2(MSH2):c.2446C>T (p.Gln816Ter) | CCTTAACTATGCTTTATYAGGTG | Hereditary Nonpolyposis Colorectal Neoplasms |
| 63750203 | MSH2 | NM_000251.2(MSH2):c.1885C>T (p.Gln629Ter) | CCATTTTGGAGAAAGGAYAAGG A | Hereditary Nonpolyposis Colorectal Neoplasms |
| 63750302 | MSH2 | NM_000251.2(MSH2):c.1183C>T (p.Gln395Ter) | CCGACTTGCCAAGAAGTTTYAAA | Hereditary Nonpolyposis Colorectal Neoplasms |
| 63750488 | MSH2 | NM_000251.2(MSH2):c.715C>T (p.Gln239Ter) | CCACAAAAGACATTTATYAGGAC | Hereditary Nonpolyposis Colorectal Neoplasms |
| 63750951 | MSH2 | NM_000251.2(MSH2):c.181C>T (p.Gln61Ter) | CCGGGAGGTGTTCAAGACCYAGG | Hereditary Nonpolyposis Colorectal Neoplasms, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 63751226 | MSH2 | NM_000251.2(MSH2):c.472C>T (p.Gln158Ter) | CCGCAGTTGATGGCYAGAGACAG | Hereditary Nonpolyposis Colorectal Neoplasms |
| 28929483 | MSH2 | NM_000251.2(MSH2):c.1865C>T (p.Pro622Leu) | CCTGTTCCATATGTACGACYAGC | Hereditary Nonpolyposis Colorectal Neoplasms, Lynch syndrome I |
| 146816935 | MSH6 | NM_000179.2(MSH6):c.892C>T (p.Arg298Ter) | CCCTGTCAAAGTTGCTYGAAAGC, CCTGTCAAAGTTGCTYGAAAGCG | Hereditary Nonpolyposis Colorectal Neoplasms, Hereditary cancer-predisposing syndrome, not provided |
| 63750563 | MSH6 | NM_000179.2(MSH6):c.3013C>T (p.Arg1005Ter) | CCAAGAAGGGCTGTAAAYGATAC | Hereditary Nonpolyposis Colorectal Neoplasms, not provided |
| 587779212 | MSH6 | NM_000179.2(MSH6):c.1483C>T (p.Arg495Ter) | CCAGAAATGATGGAGGCAYGATG | Hereditary Nonpolyposis Colorectal Neoplasms, Hereditary cancer-predisposing syndrome, not provided |
| 267606883 | MT-CO1 | m.6328C>T | CCCACCCTGGAGCCTYCGTAGAC, CCACCCTGGAGCCTYCGTAGACC | Cytochrome c oxidase i deficiency |
| 200613617 | MT-CO3 | m.9804G>A | TTTGTARCCACACAGGCTTCCACGG | Leber optic atrophy |
| 267606611 | MT-CO3 | m.9438G>A | TCCAAAARGCCTTCGATACGGG | Leber optic atrophy |
| 207459995 | MT-CYB | m.14985G>A | ATCCRCTACCTTCACGCACATGG | Familial colorectal cancer |
| 199795644 | MT-CYB | m.14831G>A | ATCTCCRCATGATGAAACTTCGG | Leber optic atrophy |
| 397515612 | MT-ND1 | m.3376G>A | CTTACCRACACGAAAAATTCTAGG | Leber optic atrophy |
| 199476115 | MT-ND2 | m.5244G>A | AACCRGCTTTTTGCCCAAATGGG, TAACCRGCTTTTTGCCCAAATGG | Leber optic atrophy |
| 121434457 | MT-TA | m.5650G>A | TAARCCCTTACTAGACCAATGGG, CTAARCCCTTACTAGACCAATGG | |
| 118203886 | MT-TF | m.611G>A | TACACTRAAAATGTTTAGACGGG, ATACACTRAAAATGTTTAGACGG | Myoclonus with epilepsy with ragged red fibers |
| 199476130 | MT-TN | m.5703G>A | AGCTAARCACCCTAATCAACTGG | |
| 587777418 | MTFMT | NM_139242.3(MTFMT):c.878G>A (p.Ser293Asn) | CCAGCAAGGACTGAAYTGTTAAC | Combined oxidative phosphorylation deficiency 15 |
| 786204030 | MTHFR | NM_005957.4(MTHFR):c.1683G>A (p.Trp561Ter) | TCACTTGRGGCATCTTCCCTGGG, GTCACTTGRGGCATCTTCCCTGG | Homocysteinemia due to MTHFR deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 786204023 | MTHFR | NM_005957.4(MTHFR):c.1088G>A (p.Arg363His) | AGATGTACRTCCCATCTTCTGGG | Homocysteinemia due to MTHFR deficiency |
| 45590836 | MTHFR | NM_005957.4(MTHFR):c.1743G>A (p.Met581Ile) | CTTCATRTTCTGGAAGGTAAAGG | Homocysteinemia due to MTHFR deficiency |
| 769381688 | MTHFR | NM_005957.4(MTHFR):c.379C>T (p.His127Tyr) | TCATGTRCAGGATGTCTCCAGG | Homocysteinemia due to MTHFR deficiency |
| 786204009 | MTHFR | NM_005957.4(MTHFR):c.244C>T (p.Arg82Trp) | CCCCCTACAGGTTTGACYGGATG, CCCTACAGGTTTGACYGGATGG, CCCTACAGGTTTGACYGGATGGC, CCTACAGGTTTGACYGGATGGCA | Homocysteinemia due to MTHFR deficiency |
| 786204021 | MTHFR | NM_005957.4(MTHFR):c.1042C>T (p.Pro348Ser) | CCCAGGCGTCCCCTAYCCTGGGC, CCAGGCGTCCCCTAYCCTGGGCT | Homocysteinemia due to MTHFR deficiency |
| 786204022 | MTHFR | NM_005957.4(MTHFR):c.1060C>T (p.His354Tyr) | CCCTGGGCTCTCAGCGCCYACCC, CCTGGGCTCTCAGCGCCYACCCC | Homocysteinemia due to MTHFR deficiency |
| 367585605 | MTHFR | NM_005957.4(MTHFR):c.1320G>A (p.Ser440=) | CCGGTTTGGTTCTCCYGAGAGGT | Homocysteinemia due to MTHFR deficiency |
| 777661576 | MTHFR | NM_005957.4(MTHFR):c.1753-18G>A | CCTACACACACATACCCCYGCAC | Homocysteinemia due to MTHFR deficiency |
| 776483190 | MTHFR | NM_005957.4(MTHFR):c.137G>A (p.Arg46Gln) | CCGCCTCATCTTCTCCYGGAGTC | Homocysteinemia due to MTHFR deficiency |
| 121434294 | MTHFR | NM_005957.4(MTHFR):c.547C>T (p.Arg183Ter) | CCTGGTGAAGCACATCYGAAGTG | Homocystinuria due to MTHFR deficiency |
| 121434296 | MTHFR | NM_005957.4(MTHFR):c.1129C>T (p.Arg377Cys) | CCAAAGAGTTACATCTACYGTAC | Homocystinuria due to MTHFR deficiency |
| 132630307 | MTM1 | NM_000252.2(MTM1):c.469G>A (p.Glu157Lys) | GAARAAAGTTTAACGTGGATGG, AAATGAARAAAGTTTAACGTGG | Severe X-linked myotubular myopathy |
| 587783778 | MTM1 | NM_000252.2(MTM1):c.1337G>A (p.Trp446Ter) | TGTGTRGCAAATGTCAAAACAGG | Severe X-linked myotubular myopathy |
| 587783779 | MTM1 | NM_000252.2(MTM1):c.1353+1G>A | AAAACAGRTAAGGAATATGAGG, CAAAACAGRTAAGGAATATGAG | Severe X-linked myotubular myopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAa11 | Phenotypes |
|---|---|---|---|---|
| 587783846 | MTM1 | NM_000252.2(MTM1):c.64-1G>A | TGTTTCTARACGTCTCGAGATGG | Severe X-linked myotubular myopathy |
| 587783832 | MTM1 | NM_000252.2(MTM1):c.535C>T (p.Pro179Ser) | CCTCACAGGGCTTGYCCAATCAC | Severe X-linked myotubular myopathy |
| 587783836 | MTM1 | NM_000252.2(MTM1):c.557C>T (p.Thr186Ile) | CCATTGGAGAATAAYTTTTATTA | Severe X-linked myotubular myopathy |
| 587783841 | MTM1 | NM_000252.2(MTM1):c.614C>T (p.Pro205Leu) | CCTGCTCTTTTGGTGGTTCYGTA | Severe X-linked myotubular myopathy |
| 587783845 | MTM1 | NM_000252.2(MTM1):c.637C>T (p.Leu213Phe) | CCTCAGATGATGACYTCCGAGA | Severe X-linked myotubular myopathy |
| 137853061 | MTRR | NM_002454.2(MTRR):c.1459G>A (p.Gly487Arg) | GGAAGRGAGTATGTACAGGCTGG | Homocystinuria-Megaloblastic anemia due to defect in cobalamin metabolism, cblE complementation type |
| 121918248 | MUT | NM_000255.3(MUT):c.52C>T (p.Gln18Ter) | CCTCATTACCTGAGGYAGTAAA | METHYLMALONIC ACIDURIA, mut(0) TYPE |
| 398123278 | MUT | NM_000255.3(MUT):c.91C>T (p.Arg31Ter) | CCAGGCTCATACAGCAAYGACTT | Methylmalonic aciduria due to methylmalonyl-CoA mutase deficiency, not provided |
| 36053993 | MUTYH | NM_001128425.1(MUTYH):c.1187G>A (p.Gly396Asp) | CAGRTCTGCTGGCAGGACTGTGG | MYH-associated polyposis, Hereditary cancer-predisposing syndrome, Endometrial carcinoma, Carcinoma of colon, not specified, not provided |
| 587781337 | MUTYH | NM_001128425.1(MUTYH):c.1186+1G>A | AACTCAGRTACCTGGATACTGGG, CAACTCAGRTACCTGGATACTGG | Hereditary cancer-predisposing syndrome |
| 748170941 | MUTYH | NM_001128425.1(MUTYH):c.309G>A (p.Trp103Ter) | CCCGTTTCTCTTGGTCGTAYCAG, CCGTTTCTCTTGGTCGTAYCAGC | MYH-associated polyposis, Hereditary cancer-predisposing syndrome |
| 140342925 | MUTYH | NM_001128425.1(MUTYH):c.734G>A (p.Arg245His) | CCAATGGCTCGGACAYGGCACAG | MYH-associated polyposis, Hereditary cancer-predisposing syndrome |
| 587780082 | MUTYH | NM_001128425.1(MUTYH):c.1012C>T (p.Gln338Ter) | CCCAGCTCCCAACACTGGAYAGT, CCAGCTCCCAACACTGGAYAGTG | Hereditary cancer-predisposing syndrome |
| 587781338 | MUTYH | NM_001128425.1(MUTYH):c.940C>T (p.Gln314Ter) | CCTCTCAGGTGGGAYAGGAACAG | Hereditary cancer-predisposing syndrome |
| 372267274 | MUTYH | NM_001128425.1(MUTYH):c.389-1G>A | CCTCTGAGACCCACAYTGGGGA | Hereditary cancer-predisposing syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587783057 | MUTYH | NM_001128425.1(MUTYH): c.1171C>T (p.Gln391Ter) | CCCAAATTCTGCTGGTGYAGAGG, CCAAATTCTGCTGGTGYAGAGGC | Carcinoma of colon |
| 104895317 | MVK | NM_000431.3(MVK):c.100 0G>A (p.Ala334Thr) | GGCRCAGGCGGTGGTGGCTGTGG | Hyperimmunoglobulin D with periodic fever, Mevalonic aciduria |
| 104895319 | MVK | NM_000431.3(MVK):c.928 G>A (p.Val310Met) | CGGCRTGGGCCACGCCTCTCTGG | Hyperimmunoglobulin D with periodic fever, Mevalonic aciduria |
| 137852604 | MXI1 | NM_130439.3(MXI1):c.362 C>T (p.Ala121Val) | CCACGGAGGTTGAGCCGGGYAC A | Neurofibrosarcoma |
| 36211723 | MYBPC3 | NM_000256.3(MYBPC3):c. 2308G>A (p.Asp770Asn) | GTCATCRGTGAGGCCGGCCCGGG, GGTCATCRGTGAGGCCGGCCGGG, AGGTCATCRGTGAGGCCGGCCGG | Primary familial hypertrophic cardiomyopathy, Familial hypertrophic cardiomyopathy 4, Cardiomyopathy |
| 727505266 | MYBPC3 | NM_000256.3(MYBPC3):c. 1219G>A (p.Gly407Ser) | TGAGCRGCAGGTGCAGCCTGGGG, ATGAGCRGCAGGTGCAGCCTGGG, GATGAGCRGCAGGTGCAGCCTGG | Cardiomyopathy, not specified |
| 730880597 | MYBPC3 | NM_000256.3(MYBPC3):c. 3641G>A (p.Trp1214Ter) | TTCCTRGTTCAAGAATGGCCTGG | Cardiomyopathy |
| 397515903 | MYBPC3 | NM_000256.3(MYBPC3):c. 1458-1G>A | GGCTARGCTGAAGGACGGGGTG G, CCCGGCTARGCTGAAGGACGGGG | Familial hypertrophic cardiomyopathy 4, Cardiomyopathy |
| 397515935 | MYBPC3 | NM_000256.3(MYBPC3):c. 1897+1G>A | TCATGGRTGAGCCTGCTCCAGGG, TTCATGGRTGAGCCTGCTCCAGG | Familial hypertrophic cardiomyopathy 4, Cardiomyopathy |
| 397515982 | MYBPC3 | NM_000256.3(MYBPC3):c. 2670G>A (p.Trp890Ter) | GTGRCGGCCCCCAGAGCGCGTGG | Familial hypertrophic cardiomyopathy, Hypertrophic cardiomyopathy |
| 397516006 | MYBPC3 | NM_000256.3(MYBPC3):c. 3233G>A (p.Trp1078Ter) | TGACGCCTRGGGTCTTAATGTGG | Familial hypertrophic cardiomyopathy 4 |
| 397516031 | MYBPC3 | NM_000256.3(MYBPC3):c. 3627+1G>A | GCCCCAAGRTAGGGAACTTTAGG | Familial hypertrophic cardiomyopathy 4, Cardiomyopathy |
| 397516041 | MYBPC3 | NM_000256.3(MYBPC3):c. 3797G>A (p.Cys1266Tyr) | GAGTRCCGCCTGGAGGTGCGAGG | Familial hypertrophic cardiomyopathy 4, Cardiomyopathy |
| 397516044 | MYBPC3 | NM_000256.3(MYBPC3):c. 3815-1G>A | TCTGCARTGCCTCAGTGACCAGG | Familial hypertrophic cardiomyopathy 4, Cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397516074 | MYBPC3 | NM_000256.3(MYBPC3):c. 772G>A (p.Glu258Lys) | TGTCCACRGTGAGGGGCCCTGG | Primary familial hypertrophic cardiomyopathy, Familial hypertrophic cardiomyopathy 4, Cardiomyopathy |
| 193922377 | MYBPC3 | NM_000256.3(MYBPC3):c. 1321G>A (p.Glu441Lys) | GGGTGGCRAGAAGTGTAGCACG G | Primary familial hypertrophic cardiomyopathy, Cardiomyopathy, not specified |
| 727503167 | MYBPC3 | NM_000256.3(MYBPC3):c. 3763G>A (p.Ala1255Thr) | TGCAGGRCCACCAACTTACAGGG, CTGCAGGRCCACCACCAACTTACAGG | Cardiomyopathy, not specified |
| 727503195 | MYBPC3 | NM_000256.3(MYBPC3):c. 1790G>A (p.Arg597Gln) | GGGCRGTGAGTGTGCAGGGCAG G, CATCGGGCRGTGAGTGTGCAGGG | Familial hypertrophic cardiomyopathy 4, Cardiomyopathy, not specified |
| 727503204 | MYBPC3 | NM_000256.3(MYBPC3):c. 1351+1G>A | AAAGRTGGGCCTGGGACCTGAGG | Familial hypertrophic cardiomyopathy 4 |
| 727503211 | MYBPC3 | NM_000256.3(MYBPC3):c. 966G>A (p.Trp322Ter) | CGTGTGRGAGATCCTACGGCAGG | Familial hypertrophic cardiomyopathy 4 |
| 727504276 | MYBPC3 | NM_000256.3(MYBPC3):c. 3335G>A (p.Trp1112Ter) | CCAGGAGTRGTTCACCGTCTTGG | Familial hypertrophic cardiomyopathy 4 |
| 727504305 | MYBPC3 | NM_000256.3(MYBPC3):c. 3331-1G>A | CCARCTGCTGTTCACCGTCTTGG | Familial hypertrophic cardiomyopathy 4 |
| 727504334 | MYBPC3 | NM_000256.3(MYBPC3):c. 2149-1G>A | CCARCTGCTGTGTGAGACCGAGG | Familial hypertrophic cardiomyopathy 4 |
| 727504349 | MYBPC3 | NM_000256.3(MYBPC3):c. 2747G>A (p.Trp916Ter) | AGTRGTGGCTGCCCTGCAGGGG, GAGTRGGTGGCTGCCCTGCAGGG, AGAGTRGGTGGCTGCCCTGCAGG | Familial hypertrophic cardiomyopathy 4 |
| 730880542 | MYBPC3 | NM_000256.3(MYBPC3):c. 1457G>A (p.Trp486Ter) | AATRGTGAGTTCCAGAAGCACGG | Cardiomyopathy |
| 730880546 | MYBPC3 | NM_000256.3(MYBPC3):c. 1731G>A (p.Trp577Ter) | TGTGTGRCTGAAGAATGGGAAGG | Cardiomyopathy |
| 730880576 | MYBPC3 | NM_000256.3(MYBPC3):c. 2748G>A (p.Trp916Ter) | AGTRGTGGCTGCCCTGCAGGGG, GAGTRGGTGGCTGCCCTGCAGGG, AGAGTRGGTGGCTGCCCTGCAGG | Cardiomyopathy |
| 730880584 | MYBPC3 | NM_000256.3(MYBPC3):c. 2995-1G>A | TCARGGCAAGCCCCGGCCTCAGG | Cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730880639 | MYBPC3 | NM_000256.3(MYBPC3):c.1223+1G>A | GGCAGRTGCAGCCTGGGGTGGGG, CGGCAGRTGCAGCCTGGGGTGGG, GCGGCAGRTGCAGCCTGGGGTGG | Cardiomyopathy |
| 730880691 | MYBPC3 | NM_000256.3(MYBPC3):c.1624+5G>A | CAGGGTGARCCTGGCTGGGGGGG | Cardiomyopathy |
| 373056282 | MYBPC3 | NM_000256.3(MYBPC3):c.2882C>T (p.Pro961Leu) | ACCRGCTCCGTGGTGGTAACAGG | Primary familial hypertrophic cardiomyopathy, Cardiomyopathy, not specified |
| 397515895 | MYBPC3 | NM_000256.3(MYBPC3):c.1273C>T (p.Gln425Ter) | CCCTGACCATCAGCYAGTGCTCA | Familial hypertrophic cardiomyopathy 4 |
| 397516005 | MYBPC3 | NM_000256.3(MYBPC3):c.3181C>T (p.Gln1061Ter) | CCACGCTGTGTGCTGYAGGTTGTT | Primary familial hypertrophic cardiomyopathy, Familial hypertrophic cardiomyopathy 4, Cardiomyopathy |
| 397516037 | MYBPC3 | NM_000256.3(MYBPC3):c.3697C>T (p.Gln1233Ter) | CCGCATGTTCAGCAAGYAGGGAG | Familial hypertrophic cardiomyopathy 4, Cardiomyopathy, Hypertrophic cardiomyopathy |
| 397516061 | MYBPC3 | NM_000256.3(MYBPC3):c.613C>T (p.Gln205Ter) | CCTGAGCAGCAAGTGGGCYAGC | Familial hypertrophic cardiomyopathy 4, Cardiomyopathy |
| 199865688 | MYBPC3 | NM_000256.3(MYBPC3):c.2497G>A (p.Ala833Thr) | CCCTCGATCATGCGCCGCGYTTC, CCTCGATCATGCGCCGCGYTTCA | Primary dilated cardiomyopathy, Primary familial hypertrophic cardiomyopathy, Familial hypertrophic cardiomyopathy 4, Left ventricular noncompaction 10, Cardiomyopathy, Paroxysmal atrial fibrillation, not specified |
| 200625851 | MYBPC3 | NM_000256.3(MYBPC3):c.1468G>A (p.Gly490Arg) | CCCGGGTCAGCTCCACCCYGTCC, CCGGGTCAGCTCCACCCYGTCCT | Primary familial hypertrophic cardiomyopathy, Familial hypertrophic cardiomyopathy 4, Left ventricular noncompaction 10, Cardiomyopathy, not specified |
| 727503216 | MYBPC3 | NM_000256.3(MYBPC3):c.557C>T (p.Pro186Leu) | CCAGCCTCCTGAAGCYGCCTGTG | Cardiomyopathy, not specified |
| 727504234 | MYBPC3 | NM_000256.3(MYBPC3):c.844C>T (p.Arg282Trp) | CCTGGCTGGAGGTGTCGYGGA | Familial hypertrophic cardiomyopathy 4, not specified |
| 730880544 | MYBPC3 | NM_000256.3(MYBPC3):c.1522C>T (p.Gln508Ter) | CCGGTTCAAGAAGGACGGGYAGA | Cardiomyopathy |
| 730880552 | MYBPC3 | NM_000256.3(MYBPC3):c.1822C>T (p.Pro608Ser) | CCATTGACGACGTCACAYCTGCC | Cardiomyopathy |
| 730880586 | MYBPC3 | NM_000256.3(MYBPC3):c.3034C>T (p.Gln1012Ter) | CCTGACCAAAGAGGGGYAGCC | Cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730880618 | MYBPC3 | NM_000256.3(MYBPC3):c. 484C>T (p.Gln162Ter) | CCTCTTCGTGATGCGGCCAYAGG | Familial hypertrophic cardiomyopathy 4, Cardiomyopathy |
| 730880699 | MYBPC3 | NM_000256.3(MYBPC3):c. 3553C>T (p.Gln1185Ter) | CCCAAGCTTCACCYAGCCCCTG | Cardiomyopathy |
| 368765949 | MYBPC3 | NM_000256.3(MYBPC3):c. 3642G>A (p.Trp1214Ter) | CCAGCCCATTCTTGAAYCAGGAA | Familial hypertrophic cardiomyopathy 4, Cardiomyopathy, not provided |
| 371488302 | MYBPC3 | NM_000256.3(MYBPC3):c. 2311G>A (p.Val771Met) | CCGCAGGTGCGTCTGGCAYGTCT | Primary dilated cardiomyopathy, Primary familial hypertrophic cardiomyopathy, Cardiomyopathy |
| 387907267 | MYBPC3 | NM_000256.3(MYBPC3):c. 2827C>T (p.Arg943Ter) | CCCGCTGCTTTCYGAGTGCGG | Familial hypertrophic cardiomyopathy 4, Cardiomyopathy |
| 104893646 | MYCN | NM_005378.5(MYCN):c.11 78G>A (p.Arg393His) | GCCAGCRCCCGCAACGACCTTCGG | Feingold syndrome 1 |
| 267606902 | MYH11 | NM_022844.2(MYH11):c.2 135G>A (p.Arg712Gln) | GCCRGCAGGGCTTCCCCAACCGG | Aortic aneurysm, familial thoracic 4, Thoracic aortic aneurysms and aortic dissections |
| 28940306 | MYH14 | NM_001145809.1(MYH14): c.3049C>T (p.Leu1017Phe) | CCAGGAGCTAGAGGCCCACYTTG | Deafness, autosomal dominant 4 |
| 119103281 | MYH14 | NM_001145809.1(MYH14): c.359C>T (p.Ser120Leu) | CCTGCCTCAACGAGGCCTYGGTC, CCTCAACGAGGCCTYGGTCCTGC | Deafness, autosomal dominant 4 |
| 121913623 | MYH3 | NM_002470.3(MYH3):c.70 0G>A (p.Ala234Thr) | TTGGGAACRCCAAGACTGTGAGG | Distal arthrogryposis type 2B |
| 121913619 | MYH3 | NM_002470.3(MYH3):c.53 3C>T (p.Thr178Ile) | CCAGTCCATTCTGATCAYGTAAG | Freeman-Sheldon syndrome, Distal arthrogryposis type 2B |
| 36211715 | MYH7 | NM_000257.3(MYH7):c.26 09G>A (p.Arg870His) | GGCTCGCCRCAAGGAGCTGGAGG | Primary familial hypertrophic cardiomyopathy, Familial hypertrophic cardiomyopathy 1, Cardiomyopathy |
| 45520836 | MYH7 | NM_000257.3(MYH7):c.55 88G>A (p.Arg1863Gln) | CCTGCTGCRCGTCGAGGACCTGG | Cardiomyopathy, not specified |
| 372381770 | MYH7 | NM_000257.3(MYH7):c.55 61C>T (p.Thr1854Met) | TCCTCCRTCTGGGGGCCAGAGGG, CTCCTCCRTCTGGGGGCCAGAGG | Primary familial hypertrophic cardiomyopathy, Cardiomyopathy, not specified |
| 3218713 | MYH7 | NM_000257.3(MYH7):c.74 6G>A (p.Arg249Gln) | ATTCATTCRAATTCATTTTGGGG | Primary familial hypertrophic cardiomyopathy, Familial hypertrophic cardiomyopathy 1, Cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397516088 | MYH7 | NM_000257.3(MYH7):c.1063G>A (p.Ala355Thr) | ACAGGCRCCATCATGCACTTTGG | Cardiomyopathy, not specified |
| 397516097 | MYH7 | NM_000257.3(MYH7):c.1273G>A (p.Gly425Arg) | TGCCACTRGGGCACTGGCCAAGG | Primary familial hypertrophic cardiomyopathy, Cardiomyopathy |
| 397516101 | MYH7 | NM_000257.3(MYH7):c.1358G>A (p.Arg453His) | CAGCCACRCCAGTACTTCATAGG | Primary familial hypertrophic cardiomyopathy, Familial hypertrophic cardiomyopathy 1, Cardiomyopathy, Hypertrophic cardiomyopathy |
| 397516135 | MYH7 | NM_000257.3(MYH7):c.2168G>A (p.Arg723His) | GTATCRCATCCTGAACCCAGCGG | Familial cardiomyopathy, not specified |
| 397516202 | MYH7 | NM_000257.3(MYH7):c.4135G>A (p.Ala1379Thr) | GGACRCCATTCAGCGACTGAGG | Primary familial hypertrophic cardiomyopathy, Familial hypertrophic cardiomyopathy 1, Cardiomyopathy |
| 397516241 | MYH7 | NM_000257.3(MYH7):c.5302G>A (p.Glu1768Lys) | AGAGRAGCTGAAGAAGGAGCAGG | Cardiomyopathy, not specified |
| 397516248 | MYH7 | NM_000257.3(MYH7):c.5401G>A (p.Glu1801Lys) | GCCRAGCAGATCGCCCTCAAGGG, AGCCRAGCAGATCGCCCTCAAGG | Myopathy, distal, 1, Familial hypertrophic cardiomyopathy 1, Cardiomyopathy |
| 730880870 | MYH7 | NM_000257.3(MYH7):c.1325G>A (p.Arg442His) | GACGCRCATCAATGCCACCCTGG | Cardiomyopathy |
| 121913628 | MYH7 | NM_000257.3(MYH7):c.2770G>A (p.Glu924Lys) | GAACRAGAGGCTGAGGATGAGG | Primary familial hypertrophic cardiomyopathy, Familial hypertrophic cardiomyopathy 1, Cardiomyopathy, Hypertrophic cardiomyopathy |
| 121913638 | MYH7 | NM_000257.3(MYH7):c.2146G>A (p.Gly716Arg) | TCTACRGGACTTCCGGCAGAGG | Primary familial hypertrophic cardiomyopathy, Familial hypertrophic cardiomyopathy 1, Cardiomyopathy, not specified |
| 121913641 | MYH7 | NM_000257.3(MYH7):c.2156G>A (p.Arg719Gln) | TCCRGCAGAGGTGGGTATGAGGG, TTCCRGCAGAGGTGGGTATGAGG | Primary familial hypertrophic cardiomyopathy, Familial hypertrophic cardiomyopathy 1, Cardiomyopathy |
| 121913645 | MYH7 | NM_000257.3(MYH7):c.667G>A (p.Ala223Thr) | CCAGRCCAACCCTGCTCTGAGG, CATCCAGRCCAACCCTGCTCTGG | Dilated cardiomyopathy 1S |
| 727504274 | MYH7 | NM_000257.3(MYH7):c.3346G>A (p.Glu1116Lys) | ACGCATCRAGGAGCTGGAGAGG | Primary familial hypertrophic cardiomyopathy, Familial hypertrophic cardiomyopathy 1, Cardiomyopathy |
| 730880156 | MYH7 | NM_000257.3(MYH7):c.532G>A (p.Gly178Arg) | ACAGCRGAGAATCCGGAGCAGG, CACAGCRGAGAATCCGGAGCAG G | Cardiomyopathy, Left ventricular noncompaction cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 267606909 | MYH7 | NM_000257.3(MYH7):c.5296G>A (p.Ala1766Thr) | GATGRCAGAGGAGCTGAAGAAG G | Left ventricular noncompaction 5 |
| 730880916 | MYH7 | NM_000257.3(MYH7):c.5254G>A (p.Glu1752Lys) | TGCTRAGGAGAAGGCCAAGAAG G | Cardiomyopathy |
| 730880903 | MYH7 | NM_000257.3(MYH7):c.3157C>T (p.Arg1053Trp) | CCTGAGCGAGCGAAGYGGAAG C | Cardiomyopathy |
| 121913637 | MYH7 | NM_000257.3(MYH7):c.2155C>T (p.Arg719Trp) | CCTCTACGGGGACTTCYGGCAGA | Primary familial hypertrophic cardiomyopathy, Familial hypertrophic cardiomyopathy 1, Cardiomyopathy |
| 727503253 | MYH7 | NM_000257.3(MYH7):c.2710C>T (p.Arg904Cys) | CCTGGCAGATGCTGAGGAGYGCT | Dilated cardiomyopathy 1S, Cardiomyopathy |
| 727503263 | MYH7 | NM_000257.3(MYH7):c.2011C>T (p.Arg671Cys) | CCCATCCCCACTTTGTAYGTTGT, CCATCCCCACTTTGTAYGTTGTA | Cardiomyopathy, not specified |
| 727504240 | MYH7 | NM_000257.3(MYH7):c.2080C>T (p.Arg694Cys) | CCTGGTCATGCACCAGCTGYGCT | Primary familial hypertrophic cardiomyopathy, Cardiomyopathy |
| 606231324 | MYH7 | NM_000257.3(MYH7):c.1573G>A (p.Glu525Lys) | CCAAAGAGGCACCTTCTGATGA | Familial cardiomyopathy, Dilated cardiomyopathy 1S, Left ventricular noncompaction cardiomyopathy |
| 730880817 | MYH7 | NM_000257.3(MYH7):c.5399C>T (p.Ala1800Val) | CCGGCTGGACGAAGYCGAGCAG A | Cardiomyopathy |
| 730880918 | MYH7 | NM_000257.3(MYH7):c.5786C>T (p.Thr1929Met) | CCGTGACATTGGCAYGAAGGTGG | Cardiomyopathy, not specified |
| 202141173 | MYH7 | NM_000257.3(MYH7):c.2606G>A (p.Arg869His) | CCTCCAGCTCCTTGCGGYGAGCC, CCAGCTCCTTGCGGYGAGCCTCG | Cardiomyopathy, not specified |
| 80338828 | MYH9 | NM_002473.5(MYH9):c.2114G>A (p.Arg705His) | GCCRCCAGGGCTTCCCCAACAGG | Deafness, autosomal dominant nonsyndromic sensorineural 17, MYH9 related disorders |
| 80338827 | MYH9 | NM_002473.5(MYH9):c.2105G>A (p.Arg702His) | GGCATCCRTATCTGCCGCCAGGG, GGGCATCCRTATCTGCCGCCAGG | Epstein syndrome, Fechtner syndrome, MYH9 related disorders |
| 80338834 | MYH9 | NM_002473.5(MYH9):c.5521G>A (p.Glu1841Lys) | TCGGACCRAGAAGAAGCTGAAG G | May-Hegglin anomaly, Fechtner syndrome, MYH9 related disorders |
| 121913657 | MYH9 | NM_002473.5(MYH9):c.287C>T (p.Ser96Leu) | CCTCAACGAAGCCTYGGTGCTGC | Epstein syndrome, MYH9 related disorders |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338835 | MYH9 | NM_002473.5(MYH9):c.57 97C>T (p.Arg193Ter) | CCGTTTGTCCTGCCCCGCYGAAT | May-Hegglin anomaly, Fechtner syndrome, Sebastian syndrome, MYH9 related disorders |
| 397516406 | MYL2 | NM_000432.3(MYL2):c.48 5G>A (p.Gly162Glu) | CCACRAGAGAGAAGGACTAG G | Familial hypertrophic cardiomyopathy 10, Cardiomyopathy |
| 199474814 | MYL2 | NM_000432.3(MYL2):c.48 4G>A (p.Gly162Arg) | CCACRGAGAGAGAAGGACTAG G | Cardiomyopathy, not specified, not provided |
| 727503309 | MYO15A | NM_016239.3(MYO15A):c. 5531+1G>A | ATCGACAGRTATCTTGGTTACGG | Deafness, autosomal recessive 3 |
| 201978571 | MYO15A | NM_016239.3(MYO15A):c. 6046+1G>A | CAGRTGGGTCAGCACCAGGCGG, GCAGRTGGGTCAGCACCAGGCG, GTGGCAGRTGGGTCAGCACCAGG | Deafness, autosomal recessive 3 |
| 727503316 | MYO15A | NM_016239.3(MYO15A):c. 7893+1G>A | CCAGRTGAGGGGGAAGGTGG G, CCCAGRTGAGGGGGGAAGGTGG G, ACCCAGRTGAGGGGGAAGGTG G | Deafness, autosomal recessive 3 |
| 121908104 | MYO5B | NM_001080467.2(MYO5B): c.1125G>A (p.Trp375Ter) | CTGRCTGTGTCATCGCAAGCTGG | Congenital microvillous atrophy |
| 121908106 | MYO5B | NM_001080467.2(MYO5B): c.1979C>T (p.Pro660Leu) | CCGTCGCATCAAGCYCAACATG | Congenital microvillous atrophy |
| 121965082 | MYO7A | NM_000260.3(MYO7A):c. 1797G>A (p.Met599Ile) | TCGCCATRGTAAGCCGGGTGCGG | Deafness, autosomal recessive 2, Usher syndrome, type 1B |
| 397516283 | MYO7A | NM_000260.3(MYO7A):c. 1200+1G>A | AAAGRTGGGCTGGAGGGAAGGG G, TAAAGRTGGGCTGGAGGGAAGG, GTAAAGRTGGGCTGGAGGGAAG G | Usher syndrome, type 1 |
| 111033178 | MYO7A | NM_000260.3(MYO7A):c. 3719G>A (p.Arg1240Gln) | CACRGACACAGCCGCCCAGCTGG | Usher syndrome, type 1 |
| 387906700 | MYO7A | NM_000260.3(MYO7A):c. 1184G>A (p.Arg395His) | CGTGCRCGACGCCTTCGTAAAGG | Deafness, autosomal recessive 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121965080 | MYO7A | NM_000260.3(MYO7A):c. 634C>T (p.Arg212Cys) | CCGCAATGACAACTCAAGCYGTT | Usher syndrome, type 1B |
| 773844428 | MYO7A | NM_000260.3(MYO7A):c. 5968C>T (p.Gln1990Ter) | CCCTCACTCACCTACYAGGTGTT, CCTCACTCACCTACYAGGTGTTC | Usher syndrome, type 1 |
| 397516291 | MYO7A | NM_000260.3(MYO7A):c. 1963C>T (p.Gln655Ter) | CCGGCACCTGTGCGTGCGCYAGC | Usher syndrome, type 1 |
| 397516321 | MYO7A | NM_000260.3(MYO7A):c. 5617C>T (p.Arg1873Trp) | CCATCGACTGCCTGCAAYGGCTC | Usher syndrome, type 1 |
| 111033180 | MYO7A | NM_000260.3(MYO7A):c. 1900C>T (p.Arg634Ter) | CCAGCCCTTCTTTGTGYGATGCA | Usher syndrome, type 1 |
| 111033182 | MYO7A | NM_000260.3(MYO7A):c. 5101C>T (p.Arg1701Ter) | CCGGCTCTTGCAGCTGYGAACGG | Usher syndrome, type 1 |
| 199606180 | MYO7A | NM_000260.3(MYO7A):c. 5660C>T (p.Pro1887Leu) | CCCGAAGTACCCTCYGCACCTG, CCGGAAGTACCCTCYGCACCTGG | Usher syndrome, type 1 |
| 74315340 | MYOC | NM_000261.1(MYOC):c.73 4G>A (p.Cys245Tyr) | AGGATRTGGAGAACTAGTTTGGG, CAGGATRTGGAGAACTAGTTTGG | Primary open angle glaucoma juvenile onset 1 |
| 74315330 | MYOC | NM_000261.1(MYOC):c.11 09C>T (p.Pro370Leu) | CCACGACAGTTCCYGTATTCTT | Primary open angle glaucoma juvenile onset 1 |
| 121908461 | MYOT | NM_006790.2(MYOT):c.11 6C>T (p.Ser39Phe) | CCAGACCAAACAGTCTTYCATTA | Spheroid body myopathy |
| 71584501 | MYPN | NM_032578.3(MYPN):c.32 63G>A (p.Arg1088His) | TGAGGGGCRCCCTCTGTCGGCTGG | Dilated cardiomyopathy 1KK, not provided |
| 587777772 | NADK2 | NM_001287341.1(NADK2): c.595C>T (p.Arg199Ter) | TGTCRTTTTCTGTGTTGAAAAAGG | 2,4-Dienoyl-CoA reductase deficiency |
| 121434529 | NAGA | NM_000262.2(NAGA):c.97 3G>A (p.Glu325Lys) | CTCTCATCRAAGTGTACATGCGG | Schindler disease, type 1 |
| 121434533 | NAGA | NM_000262.2(NAGA):c.98 6G>A (p.Arg329Gln) | CATGCRGCCTCTGTCCAACAAGG | Kanzaki disease |
| 104894590 | NAGLU | NM_000263.3(NAGLU):c.2 021G>A (p.Arg674His) | CCCTCRCTGGCGGCTTTTCCTGG | Mucopolysaccharidosis, MPS-III-B, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894593 | NAGLU | NM_000263.3(NAGLU):c.1 928G>A (p.Arg643His) | GCCRCTACCAGCTGACCTTGTGG | Mucopolysaccharidosis, MPS-III-B |
| 398123281 | NAGLU | NM_000263.3(NAGLU):c.5 03G>A (p.Trp168Ter) | ACTGCCTRGAGCCGCCAGGAGG | not provided |
| 104894595 | NAGLU | NM_000263.3(NAGLU):c.1 562C>T (p.Pro521Leu) | CCCGCTGGTCAGGCGGCGTCCC, CCGCTGGTCAGGCGGCYGTCCCT | Mucopolysaccharidosis, MPS-III-B |
| 104894596 | NAGLU | NM_000263.3(NAGLU):c.1 444C>T (p.Arg482Trp) | CCAGCTTTGCCGCCCGGYGGTAT | Mucopolysaccharidosis, MPS-III-B |
| 104894597 | NAGLU | NM_000263.3(NAGLU):c.1 693C>T (p.Arg565Trp) | CCTGCTGGACCTCACTYGGCAGG | Mucopolysaccharidosis, MPS-III-B |
| 104894601 | NAGLU | NM_000263.3(NAGLU):c.7 00C>T (p.Arg234Cys) | CCGGGTCCTGGACCAGATGYGCT | Mucopolysaccharidosis, MPS-III-B |
| 786203986 | NALCN | NM_052867.2(NALCN):c.1 768C>T (p.Leu590Phe) | CCATTTTATAGATCYTCCTGAGT | CONGENITAL CONTRACTURES OF THE LIMBS AND FACE, HYPOTONIA, AND DEVELOPMENTAL DELAY |
| 4987076 | NAT1 | NM_001160179.2(NAT1):c. 445G>A (p. Val149Ile) | GCCTTGTRTCTTCCGTTTGACGG | |
| 387907112 | NBEAL2 | NM_015175.2(NBEAL2):c. 2701C>T (p.Arg901Ter) | CCTGCTGCCCCTGCTGGAGYGAG | Gray platelet syndrome |
| 786204181 | NBN | NM_002485.4(NBN):c.216 5G>A (p.Trp722Ter) | AGAGTRGCTAAGGCAGGAAATG G | Microcephaly, normal intelligence and immunodeficiency |
| 767215758 | NBN | NM_002485.4(NBN):c.103 0C>T (p.Gln344Ter) | CCTTRTGAAAGGCTTGGTCCTGG | Microcephaly, normal intelligence and immunodeficiency |
| 119103271 | NCF1 | NM_000265.5(NCF1):c.271 C>T (p.Gln91Ter) | CCGCCGAGAACCGCYAGGGCAC A | Chronic granulomatous disease, autosomal recessive cytochrome b-positive, type 1 |
| 374402066 | NCF2 | NM_000433.3(NCF2):c.304 C>T (p.Arg102Ter) | GTTCCCTCRAAGCTGAATCAAGG | Chronic granulomatous disease, autosomal recessive cytochrome b-positive, type 2 |
| 796065032 | NCF2 | NM_000433.3(NCF2):c.366 +1G>A | GAGRTAAGGAGAACAGGGCCTG G, CCTGTGAGRTAAGGAGAACAGG G | Chronic granulomatous disease, autosomal recessive cytochrome b-positive, type 2 |
| 398123577 | NDE1 | NM_001143979.1(NDE1):c. 704-1G>A | CCARGCCTGGACGACTCCACCGG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894883 | NDP | NM_000266.3(NDP):c.302 C>T (p.Ser101Phe) | CCGGCCCCAGACTTYCAAGCTGA | Atrophia bulborum hereditaria |
| 28933684 | NDP | NM_000266.3(NDP):c.370 C>T (p.Leu124Phe) | CCACCTACCGGTACATCYTCTCC, CCTACCGGTACATCYTCTCCTGT | Familial exudative vitreoretinopathy, X-linked |
| 119483085 | NDRG1 | NM_001135242.1(NDRG1): c.442C>T (p.Arg148Ter) | CCTACATCCTAACTYGATTTGCT | Charcot-Marie-Tooth disease, type 4D |
| 606231459 | NDST1 | NM_001543.4(NDST1):c.1 831G>A (p.Gly611Ser) | ATCATCRGCCCCAGAAAACAGG | Mental retardation, autosomal recessive 46 |
| 199422225 | NDUFS1 | NM_005006.6(NDUFS1):c. 721C>T (p.Arg241Trp) | CCCTATGCCTTTACTGCCYGGCC, CCTATGCCTTTACTGCCYGGCCT | Mitochondrial complex I deficiency |
| 104893899 | NDUFS4 | NM_002495.2(NDUFS4):c. 44G>A (p.Trp15Ter) | GTTGTRGCGGAGAGGGCAGTGG | Mitochondrial complex I deficiency |
| 121434479 | NDUFS7 | NM_024407.4(NDUFS7):c. 434G>A (p.Arg145His) | CGCRCTACGTGGTCTCCATGGGG, CCGRCTACGTGGTCTCCATGGG, GCGRCTACGTGGTCTCCATGG | Leigh syndrome due to mitochondrial complex I deficiency |
| 121912638 | NDUFS8 | NM_002496.3(NDUFS8):c. 305G>A (p.Arg102His) | GCTGCRCCGGTACCCATCCGGGG, CGCTGCRCCGGTACCCATCCGGG, GCGCTGCRCCGGTACCCATCCGG | Mitochondrial complex I deficiency |
| 28939679 | NDUFS8 | NM_002496.3(NDUFS8):c. 236C>T (p.Pro79Leu) | CCTGTTCCGGAACYGGCCACCA | Mitochondrial complex I deficiency |
| 121912639 | NDUFS8 | NM_002496.3(NDUFS8):c. 254C>T (p.Pro85Leu) | CCGGCCACCATCAACTACCYGTT, CCACCATCAACTACCYGTTCGAG | Mitochondrial complex I deficiency |
| 59101996 | NEFL | NM_006158.4(NEFL):c.446 C>T (p.Ala149Val) | CCGCGACCTGCGCCTGGYGGCGG | Charcot-Marie-Tooth disease, type IF, not provided |
| 104893983 | NEU1 | NM_000434.3(NEU1):c.72 7G>A (p.Gly243Arg) | CGCTACRGAAGTGGGGTCAGCGG | Sialidosis type I, not provided |
| 104893986 | NEU1 | NM_000434.3(NEU1):c.69 G>A (p.Trp23Ter) | CTGRGGAGGCTGTAGGGTTTGGG, TCTGRGGAGGCTGTAGGGTTTGG | Sialidosis, type II |
| 28940583 | NEU1 | NM_000434.3(NEU1):c.64 9G>A (p.Val217Met) | GCCTCATCRTGTGTGGCCATGGG | Sialidosis type I |
| 104893981 | NEU1 | NM_000434.3(NEU1):c.89 3C>T (p.Ala298Val) | CCTCCGCAGCTATGATGYCTGTG, CCGCAGCTATGATGYCTGTGATA | Sialidosis, type II |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893979 | NEU1 | NM_000434.3(NEU1):c.946C>T (p.Pro316Ser) | CCCTGAGCTCGTGGACYCTGTGG, CCTGAGCTCGTGGACYCTGTGGT | Sialidosis type I |
| 786203443 | NF1 | NM_001042492.2(NF1):c.8095C>T (p.Gln2699Ter) | CCCCACCACAATACYAAACATCT | Hereditary cancer-predisposing syndrome |
| 786203448 | NF1 | NM_001042492.2(NF1):c.625C>T (p.Gln209Ter) | CCCTAAAGAAGGTTGCGYAGTTA, CCTAAAGAAGGTTGCGYAGTTAG | Hereditary cancer-predisposing syndrome |
| 768638173 | NF1 | NM_000267.3(NF1):c.2041C>T (p.Arg681Ter) | CCCCCCGATTTGCYGACAAGCC | Neurofibromatosis, type 1 |
| 137854559 | NF1 | NM_000267.3(NF1):c.4021C>T (p.Gln1341Ter) | CCAGCGGAACCTCCTTYAGATGA | Neurofibromatosis, type 1 |
| 121434259 | NF2 | NM_000268.3(NF2):c.169C>T (p.Arg57Ter) | CCGGACTCTGGGGCTCYGAGAAA | Meningioma |
| 74315501 | NF2 | NM_000268.3(NF2):c.1219C>T (p.Gln407Ter) | CCGCAGAGAGCTGAGYAGGAAATG | Neurofibromatosis, type 2 |
| 74315496 | NF2 | NM_000268.3(NF2):c.784C>T (p.Arg262Ter) | CCCGTGGAATGAAATCYGAAACA, CCGTGGAATGAAATCYGAAACAT | Neurofibromatosis, type 2 |
| 387907253 | NFIX | NM_002501.3(NFIX):c.568C>T (p.Gln190Ter) | CCTGCAGAATCCGGAYAATCAGA | Sotos syndrome 2 |
| 118204453 | NHEJ1 | NM_024782.2(NHEJ1):c.532C>T (p.Arg178Ter) | CCTTCTTATTACAGATYGATTGA | Severe combined immunodeficiency with microcephaly, growth retardation, and sensitivity to ionizing radiation |
| 104894881 | NHS | NM_198270.3(NHS):c.115C>T (p.Gln39Ter) | CCGCGCGCCCCTTGYAGCCGCC | Nance-Horan syndrome |
| 587784027 | NIPBL | NM_133433.3(NIPBL):c.6954+1G>A | GTTCAGRTAAGCATGTTTTATGG | Cornelia de Lange syndrome 1 |
| 80358367 | NIPBL | NM_015384.4(NIPBL):c.133C>T (p.Arg45Ter) | CCTTCTCTTTAATGCAYGAATAG | Cornelia de Lange syndrome 1 |
| 587783901 | NIPBL | NM_133433.3(NIPBL):c.2389C>T (p.Arg797Ter) | CCTCGGTTAAAATCAGAAYGAGC | Cornelia de Lange syndrome 1 |
| 587784062 | NIPBL | NM_133433.3(NIPBL):c.892C>T (p.Gln298Ter) | CCACCTTTAATCCTAYAATCTCA | Cornelia de Lange syndrome 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587784065 | NIPBL | NM_133433.3(NIPBL):c.92 2C>T (p.Arg308Ter) | CCTTGTTCATCACCTYGAGATGT | Cornelia de Lange syndrome 1 |
| 137852694 | NKX2-1 | NM_001079668.2(NKX2-1):c.745C>T (p.Gln249Ter) | CCGCTACAAATGAAGCGCYAG G | Benign hereditary chorea |
| 28936670 | NKX2-5 | NM_004387.3(NKX2-5):c.73C>T (p.Arg25Cys) | CCTGAACAGCAGCAGYGCAGC C | Tetralogy of Fallot, Congenital heart disease, Interrupted aortic arch, Hypothyroidism, congenital, nongoitrous, 5, Hypoplastic left heart syndrome 2, Truncus arteriosus, not specified, Malformation of the heart and great vessels, not provided |
| 104893900 | NKX2-5 | NM_004387.3(NKX2-5):c.533C>T (p.Thr178Met) | CCAGCGTGCTGAAACTCAYCTCC | Atrial septal defect 7 with or without atrioventricular conduction defects |
| 104893901 | NKX2-5 | NM_004387.3(NKX2-5):c.508C>T (p.Gln170Ter) | CCCCCGAACGCGACYAGCTGGCC | Atrial septal defect 7 with or without atrioventricular conduction defects |
| 104893902 | NKX2-5 | NM_004387.3(NKX2-5):c.656C>T (p.Ala219Val) | CCGCCTGCCCGCAGGATCGYGGT, CCGCCCGCAGGATCGYGGTGCC | Tetralogy of Fallot |
| 104893905 | NKX2-5 | NM_004387.3(NKX2-5):c.646C>T (p.Arg216Cys) | CCGCCGCCGCCGCCTGCCYGCAG, CCGCCGCCCTGCCYGCAGGAT | Tetralogy of Fallot |
| 104895564 | NLRP12 | NM_144687.3(NLRP12):c.850C>T (p.Arg284Ter) | CCTCTCCAGGAGCTCATCYGAGT | Familial cold autoinflammatory syndrome 2, not provided |
| 121908146 | NLRP3 | NM_001243133.1(NLRP3):c.1316C>T (p.Ala439Val) | CCAAGACCACCACCGYGGTGTAC | Familial cold urticaria |
| 121908149 | NLRP3 | NM_001243133.1(NLRP3):c.1055C>T (p.Ala352Val) | CCACAGAGACCTGTGYCCTGGAG | Familial amyloid nephropathy with urticaria AND deafness, Familial cold urticaria |
| 150726175 | NMNAT1 | NM_022787.3(NMNAT1):c.769G>A (p.Glu257Lys) | ACAGCTCTRAGAGTGAAGACAGG | Leber congenital amaurosis 9 |
| 387907294 | NMNAT1 | NM_022787.3(NMNAT1):c.25G>A (p.Val9Met) | GAARTGGTTCTCCTTGCTTGTGG | Leber congenital amaurosis 9 |
| 193303102 | NOBOX | NM_001080413.3(NOBOX):c.907C>T (p.Arg303Ter) | CCTGACAGTGATAAACGCYGAGA | Premature ovarian failure 5 |
| 104895461 | NOD2 | NM_022162.2(NOD2):c.1001G>A (p.Arg334Gln) | CTGCCRGCAGTGCAGTGCATGG | Sarcoidosis, early-onset, Blau syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104895460 | NOD2 | NM_022162.2(NOD2):c.14 05C>T (p.Leu469Phe) | CCCGGGGTGGCGGACCGCYTCAT, CCGGGGTGGCGGACCGCYTCATC | Sarcoidosis, early-onset, Blau syndrome |
| 121909283 | NODAL | NM_018055.4(NODAL):c.7 78G>A (p.Gly260Arg) | ACCTGATCRGATGGGGCTCCTGG | Visceral heterotaxy 5, autosomal |
| 104894612 | NOG | NM_005450.4(NOG):c.551 G>A (p.Cys184Tyr) | CGCTCGTRCTCCGTGCCCGAGGG, GCGCTCGTRCTCCGTGCCCGAGG | Cushing symphalangism |
| 587777734 | NOTCH1 | NM_017617.3(NOTCH1):c. 5965G>A (p.Asp1989Asn) | CCATCATGCATGCGGCATYCAG | Adams-Oliver syndrome 5 |
| 312262797 | NOTCH2 | NM_024408.3(NOTCH2):c. 5858G>A (p.Arg1953His) | GCTGCCCRCCTGGCTGTGGAGGG, GGCTGCCCRCCTGGCTGTGGAGG | Alagille syndrome 2 |
| 111033632 | NOTCH2 | NM_024408.3(NOTCH2):c. 1331G>A (p.Cys444Tyr) | GAGTRTCTGAAGGGTTATGCAGG | Alagille syndrome 2 |
| 312262796 | NOTCH2 | NM_024408.3(NOTCH2):c. 5857C>T (p.Arg1953Cys) | CCCCTGATCCTGGCTGCCYGCCT, CCCTGATCCTGGCTGCCYGCCTG, CCTGATCCTGGCTGCCYGCCTGG | Alagille syndrome 2 |
| 387906747 | NOTCH2 | NM_024408.3(NOTCH2):c. 6949C>T (p.Gln2317Ter) | CCCTAAAGGCAGTATTGCCYAAC, CCTAAAGGCAGTATTGCCYAACC | Hajdu-Cheney syndrome |
| 387906749 | NOTCH2 | NM_024408.3(NOTCH2):c. 7165C>T (p.Gln2389Ter) | CCCCACACCCCCTTCAYAGCACA, CCCACACCCCCTTCAYAGCACAG, CCACACCCCCTTCAYAGCACAGT | Hajdu-Cheney syndrome |
| 28933696 | NOTCH3 | NM_000435.2(NOTCH3):c. 505C>T (p.Arg169Cys) | CCGGGTGGGTGAGCCCTGCYGCC | Cerebral autosomal dominant arteriopathy with subcortical infarcts and leukoencephalopathy |
| 137852641 | NOTCH3 | NM_000435.2(NOTCH3):c. 994C>T (p.Arg332Cys) | CCACCTGCCATGACYGCGTGGCT | Cerebral autosomal dominant arteriopathy with subcortical infarcts and leukoencephalopathy |
| 120074130 | NPC1 | NM_000271.4(NPC1):c.266 5G>A (p. Val889Met) | GCCTRTGTACTTTGTCCTGGAGG, TCCGCCTRTGTACTTTGTCCTGG | NIEMANN-PICK DISEASE, TYPE C1, ADULT FORM |
| 483352891 | NPC1 | NM_000271.4(NPC1):c.236 6G>A (p.Arg789His) | TTAAACRTCAAGAGAGTAAGTTGG | Niemann-Pick disease type C1 |
| 104894458 | NPC2 | NM_006432.3(NPC2):c.358 C>T (p.Pro120Ser) | CCAGTGAAAAGCGAATATYCCTC | Niemann-Pick disease type C2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 140130028 | NPC2 | NM_006432.3(NPC2):c.441+1G>A | CCCCCAGATAGACTTAYGATCTG, CCCCAGATAGACTTAYGATCTGT, CCCAGATAGACTTAYGATCTGTA | Niemann-Pick disease type C2, not provided |
| 137852920 | NPHP4 | NM_015102.4(NPHP4):c.2044C>T (p.Arg682Ter) | CCCACCCGACAACGACGCCAYGAC, CACCCGACAACGACGCCAYGACT, CCGCAACGACGCCAYGACTGCA, CCGCAACGACGCCAYGACTGCAG | Nephronophthisis 4, Infertility, Cerebello-oculo-renal syndrome (nephronophthisis, oculomotor apraxia and cerebellar abnormalities) |
| 137852922 | NPHP4 | NM_015102.4(NPHP4):c.2335C>T (p.Gln779Ter) | CCAAGGCCGGCCGGCTGTGYAGG | Senior-Loken syndrome 4 |
| 28939695 | NPHS1 | NM_004646.3(NPHS1):c.1339G>A (p.Glu447Lys) | TGGATTRAGGGTCCCCCAGAGGG, GTGGATTRAGGGTCCCCCAGAGG | Proteinuria, Finnish congenital nephrotic syndrome, not specified |
| 758478717 | NPR2 | NM_003995.3(NPR2):c.328C>T (p.Arg110Cys) | CCCTGCTGCCTCTGTGGCCYGCT, CCTGCTGCCTCTGTGGCCYGCTT | SHORT STATURE WITH NONSPECIFIC SKELETAL ABNORMALITIES |
| 104894889 | NR0B1 | NM_000475.4(NR0B1):c.704G>A (p.Trp235Ter) | CCCTRGTGGGACACCTCCTCTGG | Congenital adrenal hypoplasia, X-linked |
| 104894894 | NR0B1 | NM_000475.4(NR0B1):c.1183C>T (p.Gln395Ter) | CCAGACGTGCCGGGCCTGYAGTG | Congenital adrenal hypoplasia, X-linked |
| 28937873 | NR2E3 | NM_014249.3(NR2E3):c.932G>A (p.Arg311Gln) | TCGGTTCCRGGCATTGGCGTGG | Goldmann-Favre syndrome, Enhanced s-cone syndrome, not provided |
| 104894493 | NR2E3 | NM_014249.3(NR2E3):c.227G>A (p.Arg76Gln) | TACRGCGGAGGCTCATCTACAGG | Enhanced s-cone syndrome |
| 6189 | NR3C1 | NM_000176.2(NR3C1):c.66G>A (p.Glu22=) | TCAGGARAGGGAGAGATGTGATGG | |
| 121912566 | NR3C2 | NM_000901.4(NR3C2):c.1897G>A (p.Gly633Arg) | TGGAARGTAAATGTTCATGTGGG, GTGGAARGTAAATGTTCATGTGG | Pseudohypoaldosteronism type 1 autosomal dominant |
| 121912573 | NR3C2 | NM_000901.4(NR3C2):c.2453C>T (p.Ser818Leu) | CCTTGAGCTGGAGATYGTACAAA | Pseudohypoaldosteronism type 1 autosomal dominant |
| 104894124 | NR5A1 | NM_004959.4(NR5A1):c.43G>A (p.Val15Met) | GTGCCCCRTGTGCGGGACAAGG | 46,XY sex reversal, type 3 |
| 104894126 | NR5A1 | NM_004959.4(NR5A1):c.271G>A (p.Gly91Ser) | GGGGTRGCCGGAACAAGTTTGGG, AGGGGTRGCCGGAACAAGTTTGG | 46,XY sex reversal, type 3 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 200749741 | NR5A1 | NM_004959.4(NR5A1):c.3 86C>T (p.Pro129Leu) | GGCGGGRGCACCCCCATCGGGG, CGGCGGGRGCACCCCCATCGGGG, GCGCGGGRGCACCCCCATCGGG | Premature ovarian failure 7, Spermatogenic failure 8 |
| 121918656 | NR5A1 | NM_004959.4(NR5A1):c.3 G>A (p.Met1Ile) | CATRGACTATTCGTACGACGAGG | 46,XY sex reversal, type 3, Premature ovarian failure 7 |
| 387906690 | NR5A1 | NM_004959.4(NR5A1):c.3 92C>T (p.Pro131Leu) | CCGATGGGGTGCCCCGCYGCC | Spermatogenic failure 8 |
| 587784131 | NSD1 | NM_022455.4(NSD1):c.496 6+1G>A | AAAGRTATGGATTTCTTATGTGG | Sotos syndrome 1 |
| 587784149 | NSD1 | NM_022455.4(NSD1):c.543 2G>A (p.Arg1811Gln) | GGCCCRAGTCTTCCCTTACATGG | Sotos syndrome 1 |
| 587784071 | NSD1 | NM_022455.4(NSD1):c.126 2G>A (p.Trp421Ter) | AGTAAATRGGAAGCCAGTGTTGG | Sotos syndrome 1 |
| 587784174 | NSD1 | NM_022455.4(NSD1):c.601 4G>A (p.Arg2005Gln) | TAGGACCRAATCATTGATGCTGG | Sotos syndrome 1 |
| 587784137 | NSD1 | NM_022455.4(NSD1):c.509 8C>T (p.Arg1700Ter) | CCCCTAGGCGGGGCTGCYGAAAAT, CCCTAGGCGGGGCTGCYGAAATC, CCTAGGCGGGGCTGCYGAAATCA | Sotos syndrome 1 |
| 587784107 | NSD1 | NM_022455.4(NSD1):c.396 4C>T (p.Arg1322Ter) | CCTTCTAGCCCGAGGTYGATCTA | Sotos syndrome 1 |
| 587784117 | NSD1 | NM_022455.4(NSD1):c.441 7C>T (p.Arg1473Ter) | CCAAGGAAGCGAAAAYGACAGA G | Sotos syndrome 1 |
| 587784151 | NSD1 | NM_022455.4(NSD1):c.556 6C>T (p.Gln1856Ter) | CCCAAAAGAGCTAAGAYAGCT G, CCAAAAGAGCTAAGAYAGCTG C | Sotos syndrome 1 |
| 587784176 | NSD1 | NM_022455.4(NSD1):c.604 9C>T (p.Arg2017Trp) | CCCAAGGAAACTATGCTYGGTT, CCAAGGAAACTATGCTYGGTTC | Sotos syndrome 1 |
| 587784209 | NSD1 | NM_022455.4(NSD1):c.655 9C>T (p.Arg2187Ter) | CCTTTGTAAGCAGCATYGAGAA | Sotos syndrome 1 |
| 587784096 | NSD1 | NM_022455.4(NSD1):c.309 1C>T (p.Arg1031Ter) | CCTTCATCCAAATTGYGAGATGC | Sotos syndrome 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587776908 | NSUN2 | NM_017755.5(NSUN2):c.2035G>A (p.Gly679Arg) | CCTTTCCCCGCCATCYGCATAAG | Mental retardation, autosomal recessive 5 |
| 587777173 | NT5C2 | NM_012229.4(NT5C2):c.85C>T (p.Arg29Ter) | TTCTCRACGATACTTTTCAGGG, CTTCTCRACGATACTTTTCAGG | |
| 150766139 | NTHL1 | NM_002528.5(NTHL1):c.268C>T (p.Gln90Ter) | CAGTCCTRGGGCTCCAGACTGG | FAMILIAL ADENOMATOUS POLYPOSIS 3 |
| 606231467 | NTRK1 | NM_002529.3(NTRK1):c.1550G>A (p.Gly517Glu) | AGCTGGRGGAGGGCGCCTTTGGG, GAGCTGGRGGAGGGCGCCTTTGG | Hereditary insensitivity to pain with anhidrosis |
| 121964868 | NTRK1 | NM_001007792.1(NTRK1): c.1976C>T (p.Pro659Leu) | CCCATTCGCTGGATGCYGCCCGA, CCATTCGCTGGATGCYGCCCGAG | Hereditary insensitivity to pain with anhidrosis |
| 62637037 | NYX | NM_022567.2(NYX):c.1049G>A (p.Trp350Ter) | AGGGACTRGATGGAGGGCTCCGG | Congenital stationary night blindness, type 1A, not provided |
| 121965042 | OAT | NM_000274.3(OAT):c.812G>A (p.Arg271Lys) | GGCCARAACTGGTAGATGGCTGG | Ornithine aminotransferase deficiency |
| 121965049 | OAT | NM_000274.3(OAT):c.955C>T (p.His319Tyr) | CCATTAAGCCAGGGGAGYATGGG | Ornithine aminotransferase deficiency |
| 121918216 | OBSL1 | NM_015311.2(OBSL1):c.1465C>T (p.Arg489Ter) | CCTTCCAGGGGTCACCYGAGAGG | Three M syndrome 2 |
| 74653330 | OCA2 | NM_000275.2(OCA2):c.1441G>A (p.Ala481Thr) | AGGAGCTRCCACTGCCATCGGGG, GAGGAGCTRCCACTGCCATCGGG | Tyrosinase-positive oculocutaneous albinism |
| 121918167 | OCA2 | NM_000275.2(OCA2):c.2228C>T (p.Pro743Leu) | CCCTGATTGACAACATCCYGTTC, CCTGATTGACAACATCCYGTTCA | Tyrosinase-positive oculocutaneous albinism |
| 121918168 | OCA2 | NM_000275.2(OCA2):c.1001C>T (p.Ala334Val) | CCCAGGTGACCATCYGACGGCC, CCAGGTGACCATCYGACGGCCA | Tyrosinase-positive oculocutaneous albinism |
| 137853260 | OCRL | NM_000276.3(OCRL):c.1499G>A (p.Arg500Gln) | TGTGACCRAATTCTTTGGAGAGG | Lowe syndrome |
| 312262864 | OFD1 | NM_003611.2(OFD1):c.1100G>A (p.Arg367Gln) | ATCRACTGATTGAAGATGAAAGG | Oral-facial-digital syndrome |
| 312262812 | OFD1 | NM_003611.2(OFD1):c.221C>T (p.Ser74Phe) | CCCTCTTAATAGGCGCCTYTAAC, CCTCTTAATAGGCGCCTYTAACT | Oral-facial-digital syndrome |
| 312262880 | OFD1 | NM_003611.2(OFD1):c.1420C>T (p.Gln474Ter) | CCTTCTTAGGCCTAGCTYAGCCG | Oral-facial-digital syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28939082 | OPA1 | NM_015560.2(OPA1):c.899 G>A (p.Gly300Glu) | TGCTGRAAAGACTAGTGTGTTGG | Dominant hereditary optic atrophy |
| 794727405 | OPA1 | NM_015560.2(OPA1):c.256 9C>T (p.Arg857Ter) | CCATTGTAACCTTTGTYGAAGAG | Dominant hereditary optic atrophy, not provided |
| 185836803 | OPLAH | NM_017570.4(OPLAH):c.3 265G>A (p.Val1089Ile) | CCAAAGGCCCCCAGGATGAYATC | 5-Oxoprolinase deficiency |
| 104894913 | OPN1LW | NM_020061.5(OPN1LW):c. 1013G>A (p.Gly338Glu) | TTCGRGAAGAAGGTTGACCATGG | Protan defect |
| 104894912 | OPN1LW | NM_020061.5(OPN1LW):c. 739C>T (p.Arg247Ter) | CCAAGTGTGGCTGGCCATCYGAG | Cone monochromatism |
| 28939688 | OPTN | NM_001008211.1(OPTN):c. 148G>A (p.Glu50Lys) | ACCRAGAACCACCAGTCTGAAAG G | Glaucoma 1, open angle, e |
| 587777528 | ORAI1 | NM_032790.3(ORAI1):c.73 4C>T (p.Pro245Leu) | CCACCATCATGGTGCYCTTCGGC | Myopathy, tubular aggregate, 2 |
| 143141689 | ORC1 | NM_004153.3(ORC1):c.31 4G>A (p.Arg105Gln) | CCTGTGCACCAGGCTTCYGGCCC | Meier-Gorlin syndrome 1 |
| 72554349 | OTC | NM_000531.5(OTC):c.299 G>A (p.Gly100Asp) | GTAGRCTTTGCACTTCTGGGAGG, ATTGTAGRCTTTGCACTTCTGGG, TATTGTAGRCTTTGCACTTCTGG | not provided |
| 72552296 | OTC | NM_000531.5(OTC):c.3G> A (p.Met1Ile) | AGRAGATRCTGTTTAATCTGAGG | not provided |
| 72552302 | OTC | NM_000531.5(OTC):c.77+ 5G>A | TAARTGATGGTCAGAGACTTGGG, GTAARTGATGGTCAGAGACTTGG | not provided |
| 72558414 | OTC | NM_000531.5(OTC):c.620 G>A (p.Ser207Asn) | ATGATGARCGCAGCGAAATTCGG | not provided |
| 72558442 | OTC | NM_000531.5(OTC):c.787 G>A (p.Asp263Asn) | ACARACACTTGGATAAGCATGGG, TACARACACTTGGATAAGCATGG | not provided |
| 72554310 | OTC | NM_000531.5(OTC):c.131 C>T (p. Thr44Ile) | CCGTGACCTTCTCAYTCTAAAAA | not provided |
| 72556254 | OTC | NM_000531.5(OTC):c.395 C>T (p.Ser132Phe) | CCACAGTGTATTGTYTAGCATGG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 72556284 | OTC | NM_000531.5(OTC):c.533 C>T (p.Thr178Met) | CCTGCTGATTACCTCAYGCTCC | not provided |
| 72558426 | OTC | NM_000531.5(OTC):c.659 C>T (p.Pro220Leu) | CCTTCAGGCAGCTACTCYAAAGG | not provided |
| 200655442 | OTOA | NM_144672.3(OTOA):c.13 52G>A (p.Gly451Asp) | GATGRCGCACTGCTGGCTGGGG, AGATGRCGCACTGCTGGCTGGG, CAGATGGRCGCACTGCTGGCTGG | Deafness, autosomal recessive 22 |
| 587777133 | OTOA | NM_144672.3(OTOA):c.18 79C>T (p.Pro627Ser) | CCTCTTGGCTGCACTCYCGTAAG | Deafness, autosomal recessive 22 |
| 397515589 | OTOF | NM_194248.2(OTOF):c.18 41G>A (p.Gly614Glu) | TCTCTTTGRAGCCTTCCTGGAGG | Deafness, autosomal recessive 9 |
| 80356592 | OTOF | NM_194248.2(OTOF):c.23 81G>A (p.Arg794His) | AGCRCCTCAAGTCTCTGCATGAGG | Deafness, autosomal recessive 9, not specified |
| 80356594 | OTOF | NM_194248.2(OTOF):c.29 91+1G>A | GAGRTGAGGGCCTGGGAGGAGG, AGAGRTGAGGGCCTGGGAGGAG G, CACAGAGRTGAGGGCCTGGGAG G | Deafness, autosomal recessive 9 |
| 368790049 | OTOF | NM_194248.2(OTOF):c.58 15C>T (p.Arg1939Trp) | CGGGCCRGCTGGAGTATGAAGGG, TCGGGCCRGCTGGAGTATGAAGG | Deafness, autosomal recessive 9 |
| 199848801 | OTOF | NM_194248.2(OTOF):c.34 00C>T (p.Arg1134Ter) | ACTCRGTACTTGCTGAGCACGGG, CACTCRGTACTTGCTGAGCACGG | Deafness, autosomal recessive 9 |
| 727504936 | OTOF | NM_194248.2(OTOF):c.28 18C>T (p.Gln940Ter) | CCAGGAGGTCAAGGCAGCCYAG G | Deafness, autosomal recessive 9 |
| 397514607 | OTOG | NM_001277269.1(OTOG): c.6347C>T (p.Pro2116Leu) | CCGGTGCTCAATCTTCCYTGACC | Deafness, autosomal recessive 18b |
| 786205224 | OTX2 | NM_172337.2(OTX2):c.23 5G>A (p.Glu79Lys) | CCCRAGTCGAGGGTGCAGGTAGG, CTTGCCCRAGTCGAGGGTGCAGG | Microphthalmia syndromic 5 |
| 121909301 | OXCT1 | NM_000436.3(OXCT1):c.9 71G>A (p.Gly324Glu) | GGGCATAGRAATCCCTCTCCTGG | Succinyl-CoA acetoacetate transferase deficiency |
| 121909302 | OXCT1 | NM_000436.3(OXCT1):c.6 56G>A (p.Gly219Glu) | GAGCAGRAAACGTGATTTTCAGG | Succinyl-CoA acetoacetate transferase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 75134564 | OXCT1 | NM_000436.3(OXCT1):c.173C>T (p.Thr58Met) | CCAAAACCRTGGCACCATCAGGG | Succinyl-CoA acetoacetate transferase deficiency |
| 137853890 | P3H1 | NM_001146289.1(P3H1):c.2073G>A (p.Ala691=) | CTCGAGCRGTGAGAGCAGCTGG | Osteogenesis imperfecta type 8 |
| 118203996 | P3H1 | NM_001146289.1(P3H1):c.1102C>T (p.Arg368Ter) | CCAAGGAGTACCGACAGYGAAGC | Osteogenesis imperfecta type 8 |
| 587784266 | PAFAH1B1 | NM_000430.3(PAFAH1B1):c.405G>A (p.Trp135Ter) | CAGGTGTGRGATTATGAGACTGG | Lissencephaly 1 |
| 587784258 | PAFAH1B1 | NM_000430.3(PAFAH1B1):c.265C>T (p.Arg89Ter) | CCTCTTGGTCAGAAAYGAGACCC | Lissencephaly 1 |
| 74503222 | PAH | NM_000277.1(PAH):c.745C>T (p.Leu249Phe) | AAARCAGGCCAGCCACAGGTCG, GAGGAAARCAGGCCAGCCACAGG | Phenylketonuria, not provided |
| 62644499 | PAH | NM_000277.1(PAH):c.1243G>A (p.Asp415Asn) | GCTACRACCCATACACCCCAAAGG | Hyperphenylalaninemia, non-pku, not provided |
| 62644503 | PAH | NM_000277.1(PAH):c.755G>A (p.Arg252Gln) | TCCTCTCRGATTTCTTGGGTGG | Phenylketonuria, not provided |
| 62514893 | PAH | NM_000277.1(PAH):c.3G>A (p.Met1Ile) | CAGCATRTCCACTGCGGTCCTGG | Phenylketonuria, not provided |
| 62514959 | PAH | NM_000277.1(PAH):c.977G>A (p.Trp326Ter) | ACTRGTTTACTGTGGAGTTTGGG, TACTRGTTTACTGTGGAGTTTGG | Phenylketonuria, not provided |
| 62516147 | PAH | NM_000277.1(PAH):c.1065+1G>A | ATTACAGRTATGACCTTCACAGG | not provided |
| 62642937 | PAH | NM_000277.1(PAH):c.1139C>T (p.Thr380Met) | CCAAAATTACACTGTCAYGGAGT | Phenylketonuria, Hyperphenylalaninemia, non-pku, not provided |
| 76687508 | PAH | NM_000277.1(PAH):c.721C>T (p.Arg241Cys) | CCCAGCTTGCACTGGTTTCYGCC, CCAGCTTGCACTGGTTTCYGCCT | Phenylketonuria, not provided |
| 5030851 | PAH | NM_000277.1(PAH):c.842C>T (p.Pro281Leu) | CCCATGTATACCCCGAACYGTG, CCATGTATACCCCCGAACYGTGA | Phenylketonuria, not provided |
| 121434611 | PAK3 | NM_002578.3(PAK3):c.1255C>T (p.Arg419Ter) | CCTGAGCAAAGTAAAYGAAGCAC | Mental retardation 30, X-linked |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587776405 | PALB2 | NM_024675.3(PALB2):c.48G>A (p.Lys16=) | GGAAAARGTGCCGGGGTGCGG G, AGGAAAARGTGCCGGGGTGCG G | not provided |
| 180177122 | PALB2 | NM_024675.3(PALB2):c.2718G>A (p.Trp906Ter) | AGTGRGAAAAACTTTATACCTGG | Familial cancer of breast |
| 180177132 | PALB2 | NM_024675.3(PALB2):c.3113G>A (p.Trp1038Ter) | ATTTRGTAAGCTTTCCCTCTAGG | Familial cancer of breast, Hereditary cancer-predisposing syndrome, Breast cancer, susceptibility to |
| 587782050 | PALB2 | NM_024675.3(PALB2):c.3476G>A (p.Trp1159Ter) | AACATTRGTCTTTTGTGAAATGG | Hereditary cancer-predisposing syndrome |
| 118203999 | PALB2 | NM_024675.3(PALB2):c.2962C>T (p.Gln988Ter) | CCCTTTCTGATCAAYAAGTAGAA | Fanconi anemia, complementation group N, Hereditary cancer-predisposing syndrome, Breast cancer, susceptibility to |
| 587776415 | PALB2 | NM_024675.3(PALB2):c.2074C>T (p.Gln692Ter) | CCAAACTCGCAAAGCYAGCATAC | not provided |
| 180177097 | PALB2 | NM_024675.3(PALB2):c.1027C>T (p.Gln343Ter) | CCAGCAAATGAAAACYAAAACTT | Familial cancer of breast, Pancreatic cancer 3, Breast cancer, susceptibility to |
| 180177111 | PALB2 | NM_024675.3(PALB2):c.2323C>T (p.Gln775Ter) | CCAGTGATACTAAAYAATTCGAC | Familial cancer of breast, Hereditary cancer-predisposing syndrome, Breast cancer, susceptibility to |
| 137852966 | PANK2 | NM_153638.2(PANK2):c.832C>T (p.Arg278Cys) | CCTGACTCTGTGTGGAYGCAAAG | |
| 137853056 | PARK2 | NM_004562.2(PARK2):c.1358G>A (p.Trp453Ter) | AGTRGAACCGCGTCTGCATGGGG GAGTRGAACCGCGTCTGCATGGG CGAGTRGAACCGCGTCTGCATGG | Parkinson disease 2 |
| 79555199 | PAX2 | NM_003990.3(PAX2):c.226G>A (p.Gly76Ser) | GAGACCRGCAGCATCAAGCCGG G, CGAGACCRGCAGCATCAAGCCGG | Renal coloboma syndrome |
| 104893651 | PAX3 | NM_181457.3(PAX3):c.251C>T (p.Ser84Phe) | CCCACGGCTGCGTCTYCAAGATC, CCACGGCTGCGTCTYCAAGATCC | Waardenburg syndrome type 1, Klein-Waardenberg syndrome |
| 1219917718 | PAX4 | NM_006193.2(PAX4):c.490C>T (p.Arg164Trp) | CCACCCAGGGACCGGCCACYGG A, CCCAGGGACCGGCCACYGGAATC, CCAGGGACCGGCCACYGGAATC G | Maturity-onset diabetes of the young, type 9 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121907929 | PAX6 | NM_000280.4(PAX6):c.771 G>A (p.Trp257Ter) | GGTATGRTTTTCTAATCGAAGGG, AGGTATGRTTTTCTAATCGAAGG | Aniridia, cerebellar ataxia, and mental retardation |
| 121907912 | PAX6 | NM_000280.4(PAX6):c.406 C>T (p.Gln136Ter) | CCTGCTAGCGAAAAGCAAYAG A | Congenital aniridia |
| 121907917 | PAX6 | NM_000280.4(PAX6):c.718 C>T (p.Arg240Ter) | CCAGATGTGTTTGCCYGAGAAAG | Congenital aniridia |
| 28933972 | PAX9 | NM_006194.3(PAX9):c.76 C>T (p.Arg26Trp) | CCGCTGCCCAACGCCATCYGGCT | Tooth agenesis, selective, 3 |
| 113994143 | PC | NM_000920.3(PC):c.1351C >T (p.Arg451Cys) | CCCTTGCGGAGTTCYGCGTCCGA | Pyruvate carboxylase deficiency |
| 115117837 | PCBD1 | NM_000281.3(PCBD1):c.2 63G>A (p.Arg88Gln) | CCAGTTTATGTCCYGTTCTGAA | Hyperphenylalaninemia, BH4-deficient, D |
| 121913014 | PCBD1 | NM_000281.3(PCBD1):c.2 36C>T (p.Thr79Ile) | CCACATCACGCTGAGCAYCCATG | Hyperphenylalaninemia, BH4-deficient, D |
| 121913015 | PCBD1 | NM_000281.3(PCBD1):c.2 92C>T (p.Gln98Ter) | CCTGGCCAGCTTCATCGAAYAAG, CCAGCTTCATCGAAYAAGTAGCA | Hyperphenylalaninemia, BH4-deficient, D |
| 121964960 | PCCB | NM_000532.4(PCCB):c.50 2G>A (p.Glu168Lys) | CCAARAAGGAGTGGAGTCTTTGG | Propionic acidemia |
| 398123460 | PCCB | NM_000532.4(PCCB):c.18 3+1G>A | ACAAGCGARTGAGTCCTGAGGGG | Propionic acidemia, not provided |
| 398123464 | PCCB | NM_000532.4(PCCB):c.3G >A (p.Met1Ile) | AATRGCGGGCATTACGGGTGG, AAAAATRGCGGCGCATTACGGG, CAAAAATRGCGCGCATTACGG | Propionic acidemia, not provided |
| 374722096 | PCCB | NM_000532.4(PCCB):c.68 3C>T (p.Pro228Leu) | CCTGTTCATCACTGGCCYTGATG | Propionic acidemia |
| 202247820 | PCCB | NM_000532.4(PCCB):c.14 95C>T (p.Arg499Ter) | CCCTTTCCCTGCAGCAGTGYGAG, CCTTTCCCTGCAGCAGTGYGAGG | Propionic acidemia |
| 186710233 | PCCB | NM_000532.4(PCCB):c.15 34C>T (p.Arg512Cys) | CCAACCTTCTTCCACAYGTGCCC | Propionic acidemia |
| 132630324 | PCDH19 | NM_001184880.1(PCDH19 ):c.253C>T (p.Gln85Ter) | CCTGCTGGTCACCAAGYAGAAGA | Early infantile epileptic encephalopathy 9 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 796052811 | PCDH19 | NM_001105243.1(PCDH19):c.1031C>T (p.Pro344Leu) | CCAATGACAATCCGCYGGTCATC | not provided |
| 119479062 | PCNT | NM_006031.5(PCNT):c.5767C>T (p.Arg1923Ter) | CCCGAGCTGCAGTGGCTCYGAGC, CCGAGCTGCAGTGGCTCYGAGCG | Microcephalic osteodysplastic primordial dwarfism type 2 |
| 587784321 | PCNT | NM_006031.5(PCNT):c.8917C>T (p.Arg2973Ter) | CCACCTCCGGAACAGCAGYGA G, CCTCCGGGAACAGCAGYGAGAG C | Microcephalic osteodysplastic primordial dwarfism type 2 |
| 794728683 | PCSK9 | NM_174936.3(PCSK9):c.644G>A (p.Arg215His) | CGGGACCCRCTTCCACAGACAGG | not provided |
| 374603772 | PCSK9 | NM_174936.3(PCSK9):c.1486C>T (p.Arg496Trp) | CCAGGAGTGGGAAGCGGYGGGG C | not provided |
| 587777189 | PCYT1A | NM_005017.3(PCYT1A):c.296C>T (p.Ala99Val) | CTTCRCTTGCATCAGAGCTCGGG, TCTTCRCTTGCATCAGAGCTCGG | Spondylometaphyseal dysplasia with cone-rod dystrophy |
| 794726867 | PDE3A | NM_000921.4(PDE3A):c.1340C>T (p.Ala447Val) | CCACCACCACCTCCGYCACAGGT | Brachydactyly with hypertension |
| 397515433 | PDE4D | NM_001165899.1(PDE4D):c.728C>T (p.Ala243Val) | CCGTCAGTGAGATGYCTCCAAC | Acrodysostosis 2, with or without hormone resistance |
| 794727139 | PDE6A | NM_000440.2(PDE6A):c.1926+1G>A | CGAGRTAGGATGAGGGCCAAGG G, ACGAGRTAGGATGAGGGCCAAG G | Retinitis pigmentosa 43 |
| 121918578 | PDE6A | NM_000440.2(PDE6A):c.1683G>A (p.Trp561Ter) | CTGRCGGCACGGCTTCAACGTGG | Retinitis pigmentosa 43 |
| 121918581 | PDE6B | NM_000283.3(PDE6B):c.1669C>T (p.His557Tyr) | CCGGAGAATCACCTACYACAACT | Retinitis pigmentosa, Retinitis pigmentosa 40 |
| 397515633 | PDGFB | NM_002608.2(PDGFB):c.445C>T (p.Arg149Ter) | CCCCACCCAGGTGCAGCTGYGAC, CCACCCAGGTGCAGCTGYGACC, CCACCCAGGTGCAGCTGYGACCT, CCCAGGTGCAGCTGYGACCTGTC | Idiopathic basal ganglia calcification 5 |
| 121908587 | PDGFRA | NM_006206.4(PDGFRA):c.2021C>T (p.Thr674Ile) | CCCCATTTACATCATCAYAGAGT, CCCATTTACATCATCAYAGAGTA, CCATTTACATCATCAYAGAGTAT | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397509382 | PDGFRB | NM_002609.3(PDGFRB):c.2959C>T (p.Arg987Trp) | CCACCCAGCCATCTTYGGTCCC | Basal ganglia calcification, idiopathic, 4 |
| 137853250 | PDHA1 | NM_000284.3(PDHA1):c.1133G>A (p.Arg378His) | AAGTTCRTGTGCCAATCAGTGG | Pyruvate dehydrogenase E1-alpha deficiency |
| 137853252 | PDHA1 | NM_000284.3(PDHA1):c.904C>T (p.Arg302Cys) | CCCTCCCCATAGTTACYGTACAC, CCTCCCCATAGTTACYGTACACG | Pyruvate dehydrogenase E1-alpha deficiency, not provided |
| 121917722 | PEPD | NM_000285.3(PEPD):c.551G>A (p.Arg184Gln) | CTGAAGCCRAGTGTGTTTAAGACGG | Prolidase deficiency |
| 121917724 | PEPD | NM_000285.3(PEPD):c.1342G>A (p.Gly448Arg) | TTGGCRGGGTGAGTGCCCACGGG, TTTGGCRGGGTGAGTGCCCACGG | Prolidase deficiency |
| 61750420 | PEX1 | NM_000466.2(PEX1):c.2528G>A (p.Gly843Asp) | TTGRTGGGTTACATGAAGTTAGG | Leber amaurosis, Zellweger syndrome, Peroxisome biogenesis disorders, Zellweger syndrome spectrum, not provided |
| 267608183 | PEX10 | NM_002617.3(PEX10):c.60+1G>A | TACRTAAGTAGCAGGCGCTGAGG | Peroxisome biogenesis disorder 6A |
| 397515419 | PEX11B | NM_003846.2(PEX11B):c.64C>T (p.Gln22Ter) | CCTCTCCTCTAGGGCCGCCYAGT, CCTCTAGGGCCGCCYAGTATGCT | Peroxisome biogenesis disorder 14B |
| 61752112 | PEX12 | NM_000286.2(PEX12):c.949C>T (p.Leu317Phe) | CCGGGTGAATGATACTGTTYTTG | |
| 61752127 | PEX2 | NM_001079867.1(PEX2):c.669G>A (p.Trp223Ter) | TCATGRTGTATTCCTCTTACTGG | Peroxisome biogenesis disorder 5B |
| 28940308 | PEX26 | NM_017929.5(PEX26):c.265G>A (p.Gly89Arg) | TGTTGTGRGGATCCAGGCCCTGG | Peroxisome biogenesis disorder 7A |
| 62641228 | PEX26 | NM_017929.5(PEX26):c.292C>T (p.Arg98Trp) | CCCTGGCAGAAATGGATYGGTGG, CCTGGCAGAAATGGATYGGTGGC | Peroxisome biogenesis disorder 7B |
| 61752137 | PEX5 | NM_000319.4(PEX5):c.1255C>T (p.Arg419Ter) | CCTGTGAAACCCTAYGAGACTGG | Peroxisome biogenesis disorder 2A |
| 267608241 | PEX6 | NM_000287.3(PEX6):c.2440C>T (p.Arg814Ter) | CCCCAAGCCRGGGGYGAAGTGGA | Peroxisome biogenesis disorder 4A |
| 267608252 | PEX7 | NM_000288.3(PEX7):c.-45C>T | CCTCCGACTCGGAAYGGCTTCCG | Phytanic acid storage disease |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587776970 | PGAP2 | NM_001145438.2(PGAP2): c.479C>T (p.Thr160Ile) | CCACTACCTTCAGCTGCAYCTCCC | Hyperphosphatasia with mental retardation syndrome 3 |
| 587777251 | PGAP3 | NM_033419.4(PGAP3):c.2 75G>A (p.Gly92Asp) | CCCTCCAACTCACCTTGYCATGG, CCTCCAACTCACCTTGYCATGGA | Hyperphosphatasia with mental retardation syndrome 4 |
| 431905503 | PGK1 | NM_000291.3(PGK1):c.756 +5G>A | GGTAGRAAACAAATGCCAAGTG G | Phosphoglycerate kinase 1 deficiency |
| 132630299 | PHF6 | NM_001015877.1(PHF6):c. 134G>A (p.Cys45Tyr) | TAAGTRCATGGTAAGTATACCGG | Borjeson-Forssman-Lehmann syndrome |
| 587777483 | PHGDH | NM_006623.3(PHGDH):c.4 88G>A (p.Arg163Gln) | CTACCCRGATGCAGTCCTTTGGG, GCTACCCRGATGCAGTCCTTTGG | Neu-Laxova syndrome 1 |
| 587777770 | PHGDH | NM_006623.3(PHGDH):c.4 18G>A (p.Gly140Arg) | TTCATGRGAACAGAGCTGAATGG | Neu-Laxova syndrome 1, not provided |
| 587777774 | PHGDH | NM_006623.3(PHGDH):c.7 93G>A (p.Glu265Lys) | GCAGRAGCCGCCACGGGACCGG G, GGCAGRAGCCGCCACGGGACCG G | Neu-Laxova syndrome 1 |
| 267606948 | PHGDH | NM_006623.3(PHGDH):c.1 129G>A (p.Gly377Ser) | CATTGTCRGCCTCCTGAAAGAGG | Phosphoglycerate dehydrogenase deficiency |
| 137853590 | PHKG2 | NM_000294.2(PHKG2):c.1 30C>T (p.Arg44Ter) | CCGCCGTTGTGTTCATYGAGCTA | Glycogen storage disease IXc |
| 104894269 | PHOX2A | NM_005169.3(PHOX2A):c. 215C>T (p.Ala72Val) | CCCGCGCCCTACTCCGYAGGTGA, CCGCGCCCTACTCCGYAGGTGAG | Fibrosis of extraocular muscles, congenital, 2 |
| 587777764 | PIEZO1 | NM_001142864.3(PIEZO1): c.6059C>T (p.Ala2020Val) | GAGGRCGCGTCAACCACCATGG | Xerocytosis |
| 587777450 | PIEZO2 | NM_022068.3(PIEZO2):c.8 057G>A (p.Arg2686His) | CCCACTGAAGAATTCAYGGACAA, CCACTGAAGAATTCAYGGACAAA | Gordon syndrome |
| 368953604 | PIGO | NM_032634.3(PIGO):c.306 9+5G>A | CCCTGATCTCTCTCCTACAYCCA, CCTGATCTCTCTCCTACAYCCAC | Hyperphosphatasia with mental retardation syndrome 2 |
| 527236031 | PIGT | NM_015937.5(PIGT):c.134 2C>T (p.Arg448Trp) | CCATCCAGTTTGAGYGGGGCCTG | Multiple congenital anomalies-hypotonia-seizures syndrome 3 |
| 397514565 | PIK3CA | NM_006218.2(PIK3CA):c.1 133G>A (p.Cys378Tyr) | CCTTRTTCCAATCCCAGGTAAGG | Megalencephaly cutis marmorata telangiectatica congenita, PIK3CA Related Overgrowth Spectrum |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913273 | PIK3CA | NM_006218.2(PIK3CA):c.1624G>A (p.Glu542Lys) | TCTCTCTRAAATCACTGAGCAGG | Congenital lipomatous overgrowth, vascular malformations, and epidermal nevi, Non-small cell lung cancer, Neoplasm of ovary |
| 587777389 | PIK3CD | NM_005026.3(PIK3CD):c.1573G>A (p.Glu525Lys) | GTATRAGCACGAGAAGGACCTGG | Activated PI3K-delta syndrome |
| 121918337 | PIKFYVE | NM_015040.3(PIKFYVE):c.2962C>T (p.Gln988Ter) | CCCTGTGGATGACCAAYAAGATG, CCTGTGGATGACCAAYAAGATGC | Fleck corneal dystrophy |
| 121909109 | PITX1 | NM_002653.4(PITX1):c.388G>A (p.Glu130Lys) | CCCTCACCRAGCCGCGCTGCCGG, ACCTCACCRAGCCGCGCGTGCGG | Talipes equinovarus |
| 104893861 | PITX2 | NM_153427.2(PITX2):c.206G>A (p.Arg69His) | CACRCGAAGAAATCGTGTGTGG | Iridogoniodysgenesis, dominant type |
| 121909248 | PITX2 | NM_153427.2(PITX2):c.250C>T (p.Arg84Trp) | CCCTTACGGAAGCCCCAGTCYGGG | Iridogoniodysgenesis, dominant type |
| 199476102 | PKD1 | NM_001009944.2(PKD1):c.12420G>A (p.Trp4140Ter) | CCCTCTGRATGGGCCTCAGCAAGG | Polycystic kidney disease, adult type |
| 199476095 | PKD1 | NM_001009944.2(PKD1):c.12682C>T (p.Arg4228Ter) | CCTGCTCACCCAGTTTGACYGAC | Polycystic kidney disease, adult type |
| 199476096 | PKD1 | NM_001009944.2(PKD1):c.11512C>T (p.Gln3838Ter) | CCGGCTGCGCTTCCTGYAGCTGC | Polycystic kidney disease, adult type |
| 121918042 | PKD2 | NM_000297.3(PKD2):c.1390C>T (p.Arg464Ter) | CCTTTAAAGCTGATCYGATATGT | Polycystic kidney disease 2 |
| 794727680 | PKHD1 | NM_138694.3(PKHD1):c.7194G>A (p.Trp2398Ter) | ACAGTTTGRGAAAGTGCAGGTGG | Polycystic kidney disease, infantile type |
| 786204241 | PKHD1 | NM_138694.3(PKHD1):c.8303-1G>A | CACARACAGAACTGTCCTTGTGG | Polycystic kidney disease, infantile type |
| 398124479 | PKHD1 | NM_138694.3(PKHD1):c.2407+1G>A | TTTCTGRTAAAGGGGTGATTGGGG, TTTCTGRTAAAGGGGTGATTGGG, ATTTCTGRTAAAGGGGTGATTGG | Polycystic kidney disease, infantile type, not provided |
| 137852946 | PKHD1 | NM_138694.3(PKHD1):c.5221G>A (p. Val1741Met) | ACAGCARTGACGCGAGAACTTCGG | Polycystic kidney disease, infantile type, not provided |
| 28937907 | PKHD1 | NM_138694.3(PKHD1):c.4991C>T (p.Ser1664Phe) | CCAGAATTGATCTCTATTYTCA | Polycystic kidney disease, infantile type |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 773136605 | PKHD1 | NM_138694.3(PKHD1):c.2854G>A (p.Gly952Arg) | CCAGAGAAACCAGTTCYGTAAT | Polycystic kidney disease, infantile type |
| 727504096 | PKHD1 | NM_138694.3(PKHD1):c.370C>T (p.Arg124Ter) | CCAAATCCAGGACCAYGAGATAG | Polycystic kidney disease, infantile type, not provided |
| 398124478 | PKHD1 | NM_138694.3(PKHD1):c.2341C>T (p.Arg781Ter) | CCTGTGACGACACAGAGAYGAC | Polycystic kidney disease, infantile type, not provided |
| 398124480 | PKHD1 | NM_138694.3(PKHD1):c.2452C>T (p.Gln818Ter) | CCTTCACCAGCTCTTAYAGAATA | Polycystic kidney disease, infantile type, not provided |
| 137852944 | PKHD1 | NM_138694.3(PKHD1):c.107C>T (p.Thr36Met) | CCTTGCAGGGGAAVGTGGATCA | Polycystic kidney disease, infantile type |
| 137852945 | PKHD1 | NM_138694.3(PKHD1):c.9053C>T (p.Ser3018Phe) | CCTGATCATATCATYTACTCTG | Polycystic kidney disease, infantile type |
| 137852947 | PKHD1 | NM_138694.3(PKHD1):c.8011C>T (p.Arg2671Ter) | CCTCCTAAGATGTGGGAGTYGAG, CCTAAGATGTGGGAGTYGAGTGG | Polycystic kidney disease, infantile type |
| 118204085 | PKLR | NM_000298.5(PKLR):c.1436G>A (p.Arg479His) | TGGCCRGTGAGGGGGATATTGGG, CTGGCCRGTGAGGGGGATATTGG | |
| 116100695 | PKLR | NM_000298.5(PKLR):c.1456C>T (p.Arg486Trp) | TCGGTACCRAGACAGAAGCTGGG | Pyruvate kinase deficiency of red cells |
| 118204083 | PKLR | NM_000298.5(PKLR):c.487C>T (p.Arg163Cys) | CCAAGGGACCGGAGATCYGCACT | Pyruvate kinase deficiency of red cells |
| 74315362 | PKLR | NM_000298.5(PKLR):c.1151C>T (p.Thr384Met) | CCAAGCCCCGGCCAAYGAGGGCA | Pyruvate kinase deficiency of red cells |
| 121918354 | PKP1 | NM_000299.3(PKP1):c.910C>T (p.Gln304Ter) | CCCCAACCAGAACGTCYAGCAGG, CCCAACCAGAACGTCYAGCAGC, CCAACCAGAACGTCYAGCAGGCC | Ectodermal dysplasia skin fragility syndrome |
| 766209297 | PKP2 | NM_004572.3(PKP2):c.1162C>T (p.Arg388Trp) | TCTTCCRAGCTTCAGATTTCTGG | not provided |
| 794729103 | PKP2 | NM_004572.3(PKP2):c.517C>T (p.Gln173Ter) | CCAGTACAGCCAGAGAAGCYAGG | not provided |
| 121908686 | PLA2G6 | NM_003560.2(PLA2G6):c.2222G>A (p.Arg741Gln) | GGCRGGCTGTGGACCGGGCACGG, AGACGGGCRGGCTGTGGACCGGG | Parkinson disease 14 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 370691849 | PLA2G6 | NM_003560.2(PLA2G6):c.1612C>T (p.Arg538Cys) | CATGCCGCRCATGTAGGCCATGG | Iron accumulation in brain |
| 121908683 | PLA2G6 | NM_003560.2(PLA2G6):c.1894C>T (p.Arg632Trp) | CCTAGACCAGCTGGTGTGGYGGG | Karak syndrome |
| 587784338 | PLA2G6 | NM_003560.2(PLA2G6):c.1754C>T (p.Thr585Ile) | CCAGGGTGATGCTGAYAGGGAC A | Iron accumulation in brain |
| 587784357 | PLA2G6 | NM_003560.2(PLA2G6):c.517C>T (p.Gln173Ter) | CCTGGTGGAGCTGGTGYAGTACT | Iron accumulation in brain |
| 397514770 | PLCB4 | NM_001172646.1(PLCB4):c.1078G>A (p.Asp360Asn) | CTTRACTGCTGGGATGGAAAAGG | Auriculocondylar syndrome 2 |
| 397514470 | PLCD1 | NM_006225.3(PLCD1):c.1246C>T (p.Arg416Ter) | CCCCATGCTGTTGAACYGACCAC, CCCATGCTGTTGAACYGACCACT, CCATGCTGTTGAACYGACCACTG | Leukonychia totalis |
| 121912605 | PLCE1 | NM_016341.3(PLCE1):c.4451C>T (p.Ser1484Leu) | CCTGCCAATCATCATATYGATTG | Nephrotic syndrome, type 3 |
| 137853160 | PLEC | NM_000445.4(PLEC):c.913C>T (p.Gln305Ter) | CCTGCCCGCAGGAGCTGYAGCTG | Epidermolysis bullosa simplex with pyloric atresia |
| 387906801 | PLEC | NM_000445.4(PLEC):c.6169C>T (p.Gln2057Ter) | CCTGCGGGAGCGAGCGGAGYAG G | Epidermolysa bullosa simplex and limb girdle muscular dystrophy |
| 387906802 | PLEC | NM_000445.4(PLEC):c.6955C>T (p.Arg2319Ter) | CCCAAGAGGCTGCGYGACTGCGG | Epidermolysa bullosa simplex and limb girdle muscular dystrophy |
| 786205055 | PLEKHM1 | NM_014798.2(PLEKHM1):c.296+1G>A | CAARTGAGATTTAGCTGGAGAGG, ACCCACAARTGAGATTTAGCTGG | Osteopetrosis autosomal recessive 6 |
| 121918027 | PLG | NM_000301.3(PLG):c.1858G>A (p.Ala620Thr) | GTTGACTRCTGCCCACTGCTTGG | Dysplasminogenemia |
| 121918030 | PLG | NM_000301.3(PLG):c.704G>A (p.Arg235His) | TTACTGTCRTAACCCGATAGGG | Plasminogen deficiency, type I |
| 121913550 | PLOD1 | NM_000302.3(PLOD1):c.955C>T (p.Arg319Ter) | CCCCAGAAACACATGYGACTTT, CCCAGAAACACATGYGACTTTT, CCCAGAAACACATGYGACTTTC | Ehlers-Danlos syndrome, hydroxylysine-deficient |
| 132630278 | PLP1 | NM_001128834.2(PLP1):c.646C>T (p.Pro216Ser) | CCCATGGAATGCTTTCYCTGGCA, CCATGGAATGCTTTCYCTGCAA | Pelizaeus-Merzbacher disease, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 132630293 | PLP1 | NM_001128834.2(PLP1):c. 725C>T (p.Ala242Val) | CCTTCCACCTGTTTATTGYTGCA, CCACCTGTTTATTGYTGCATTTG | |
| 132630294 | PLP1 | NM_001128834.2(PLP1):c. 509C>T (p.Ser170Phe) | CCTGTGTTTGCCTGCTYTGCTG | Spastic paraplegia 2 |
| 80338707 | PMM2 | NM_000303.2(PMM2):c.69 1G>A (p. Val23lMet) | CTACTCCRTGACAGCGCCTGAGG | Carbohydrate-deficient glycoprotein syndrome type I, not provided |
| 104894621 | PMP22 | NM_000304.3(PMP22):c.21 5C>T (p.Ser72Leu) | CCACCATGATCCTGTYGATCATC | Dejerine-Sottas disease, Dejerine-Sottas syndrome, autosomal dominant |
| 587778617 | PMS2 | NM_000535.5(PMS2):c.126 1C>T (p.Arg421Ter) | CCATTTCCAGACTGYGAGAGGCC | Hereditary Nonpolyposis Colorectal Neoplasms, not specified |
| 267606956 | PNKP | NM_007254.3(PNKP):c.97 6G>A (p.Glu326Lys) | CTGAGRAGTTCTTTCTCAAGTGG | Early infantile epileptic encephalopathy 10, not provided |
| 104894453 | PNP | NM_000270.3(PNP):c.265 G>A (p.Glu89Lys) | TGTATRAAGGGTACCCACTCTGG | Purine-nucleoside phosphorylase deficiency |
| 121918260 | PNPLA2 | NM_020376.3(PNPLA2):c. 865C>T (p.Gln289Ter) | CCAAGCGGAGGATTACTCGYAGC | Neutral lipid storage disease with myopathy |
| 142422525 | PNPLA6 | NM_006702.4(PNPLA6):c. 3382G>A (p.Gly1128Ser) | TGTCCRGCTGGTGGCTGCTGTGG | Trichomegaly with mental retardation, dwarfism and pigmentary degeneration of retina |
| 587777185 | PNPLA6 | NM_006702.4(PNPLA6):c. 2375G>A (p.Gly792Glu) | GTCAGRGTGCGTGGCCCAGCAGG | Spastic paraplegia 39 |
| 786201037 | PNPLA6 | NM_006702.4(PNPLA6):c. 3152G>A (p.Arg1051Gln) | TGCRAGTCCACAAAGATGGTGGG, ATGCRAGTCCACAAAGATGGTGG, GCCATGCRAGTCCACAAGATGG | Trichomegaly with mental retardation, dwarfism and pigmentary degeneration of retina |
| 587777181 | PNPLA6 | NM_006702.4(PNPLA6):c. 3029C>T (p.Thr1010Ile) | CCTCACGTACCCAGTCAYCTCCA | Boucher Neuhauser syndrome |
| 587777854 | PNPLA6 | NM_006702.4(PNPLA6):c. 3295C>T (p.Arg1099Cys) | CCCCACAGCGGACATCGCCYGCA, CCCACAGCGGACATCGCCYGCAG, CCACAGCGGACATCGCCYGCAGC | Boucher Neuhauser syndrome |
| 773450573 | PNPO | NM_018129.3(PNPO):c.68 6G>A (p.Arg229Gln) | GACCRGATAGTCTTTCGGCGGGG, TGACCRGATAGTCTTTCGGCGGG, ATGACCRGATAGTCTTTCGGCGG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894629 | PNPO | NM_018129.3(PNPO):c.68 5C>T (p.Arg229Trp) | CCAACCGCCTGCATGACYGGATA | "Pyridoxal 5-phosphate-dependent epilepsy" |
| 397514487 | POC1A | NM_015426.4(POC1A):c.2 41C>T (p.Arg81Ter) | CCTGCTTGCTTCCGGCTCCYGAG | Short stature, onychodysplasia, facial dysmorphism, and hypotrichosis, Primordial dwarfism |
| 587777293 | POGLUT1 | NM_152305.2(POGLUT1): c.11G>A (p.Trp4Ter) | GGTRGGCTAGCTCGCGCTTCGG | Dowling-degos disease 4 |
| 199759055 | POLG | NM_002693.2(POLG):c.11 56C>T (p.Arg386Cys) | GTTCTCACRAATGTCCTTCATGG | not provided |
| 769410130 | POLG | NM_002693.2(POLG):c.91 5C>G (p.Ser305Arg) | GAAGCTRCTTAGCCCTGAGATGG | not provided |
| 796052888 | POLG | NM_002693.2(POLG):c.25 58G>A (p.Arg853Gln) | GCCRGGCTGTGGAGCCCACATGG | not provided |
| 121918055 | POLG | NM_002693.2(POLG):c.15 32G>A (p.Ser511Asn) | CCARCAAGTTGCCATGCAGGGG, GCCARCAAGTTGCCATGCAGGG, AGCCARCAAGTTGCCATGCAGG | Autosomal dominant progressive external ophthalmoplegia with mitochondrial DNA deletions 1 |
| 144500145 | POLG | NM_002693.2(POLG):c.25 54C>T (p.Arg852Cys) | AGCCCGGCRAGTGATGGTGCCGG | Sensory ataxic neuropathy, dysarthria, and ophthalmoparesis, Cerebellar ataxia infantile with progressive external ophthalmoplegia, not provided |
| 113994098 | POLG | NM_002693.2(POLG):c.25 42G>A (p.Gly848Ser) | TGCCRGCACCATCACTCGCGGG, CTGCCRGCACCATCACTCGCCGG | Progressive sclerosing poliodystrophy, Cerebellar ataxia infantile with progressive external ophthalmoplegia, Mitochondrial DNA depletion syndrome 4B, MNGIE type, not provided |
| 56047213 | POLG | NM_002693.2(POLG):c.34 06G>A (p.Glu1136Lys) | CCAGGTAGCGAACCTYGTCATGG | not provided |
| 121918053 | POLG | NM_002693.2(POLG):c.25 57C>T (p.Arg853Trp) | CCGGCACCATCACTCGCYGGGCT | Cerebellar ataxia infantile with progressive external ophthalmoplegia, not provided |
| 121918056 | POLG | NM_002693.2(POLG):c.67 9C>T (p.Arg227Trp) | CCTGGTGCAGCCAGYGGCTGGTG | Mitochondrial DNA depletion syndrome 4B, MNGIE type |
| 113994094 | POLG | NM_002693.2(POLG):c.75 2C>T (p.Thr251Ile) | CCCCCTGGAGGTCCCTAYTGGTG, CCCTGGAGGTCCCTAYTGGTGC, CCCTGGAGGTCCCTAYTGGTGCC, CCTGGAGGTCCCTAYTGGTGCCA | Myoneural gastrointestinal encephalopathy syndrome, Progressive sclerosing poliodystrophy, Cerebellar ataxia infantile with progressive external ophthalmoplegia, Mitochondrial DNA depletion syndrome 4B, MNGIE type, not specified, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 113994096 | POLG | NM_002693.2(POLG):c.17 60C>T (p.Pro587Leu) | CCCTCCATGACCCGGGCCCCA | Myoneural gastrointestinal encephalopathy syndrome, Cerebellar ataxia infantile with progressive external ophthalmoplegia, Mitochondrial DNA depletion syndrome 4B, MNGIE type, not specified, not provided |
| 141156009 | POLR1C | NM_203290.2(POLR1C):c. 835C>T (p.Arg279Trp) | CCAGAGTTGCCAACCCCYGGCTG | Mandibulofacial dysostosis, Treacher Collins type, autosomal recessive |
| 796052126 | POLR1C | NM_203290.2(POLR1C):c. 77C>T (p.Thr26Ile) | CCTTTGCTCTAGGTCCATAYTAC | LEUKODYSTROPHY, HYPOMYELINATING, 11 |
| 267608673 | POLR3A | NM_007055.3(POLR3A):c. 1114G>A (p.Asp372Asn) | TCTCCGCCRACCCCAACCTCGG | Hypomyelinating leukodystrophy 7 |
| 267608677 | POLR3A | NM_007055.3(POLR3A):c. 1909+18G>A | GAACTCRGGTGGGAGAAGGAGG | Hypomyelinating leukodystrophy 7 |
| 267608680 | POLR3A | NM_007055.3(POLR3A):c. 3991G>A (p.Ala1331Thr) | TCTTTGACRCTGCCTACTTCGGG | Hypomyelinating leukodystrophy 7 |
| 267608678 | POLR3A | NM_007055.3(POLR3A):c. 418C>T (p.Arg140Ter) | CCTGACCTACCTTCAGAAGYGAG CCTACCTTCAGAAGYGAGGACTG | Hypomyelinating leukodystrophy 7 |
| 387907299 | POMGNT 2 | NM_032806.5(POMGNT2) :c.1333C>T (p.Arg445Ter) | CCCGAGTGGCTCTTCYGAATCT, CCCGAGTGGCTCTTCYGAATCTA, CCGAGTGGCTCTTCYGAATCTAC | Congenital muscular dystrophy-dystroglycanopathy with brain and eye anomalies, type A8 |
| 28941782 | POMT1 | NM_007171.3(POMT1):c.2 26G>A (p.Gly76Arg) | CTTGRGAGGTAGGAGTCATCAGG | Walker-Warburg congenital muscular dystrophy |
| 397515400 | POMT1 | NM_007171.3(POMT1):c.1 241C>T (p.Thr414Met) | CCACCCGCTCCCTGAACAYGTGA, CCCGCTCCCTGAACAYGTGAGTG, CCGCTCCCTGAACAYGTGAGTGT | Limb-girdle muscular dystrophy-dystroglycanopathy, type C1 |
| 267606969 | POMT2 | NM_013382.5(POMT2):c.2 177G>A (p.Gly726Glu) | TTACCRGATCGTTGGTCCCCTGG | Congenital muscular dystrophy with brain and eye anomalies, type A2, Congenital muscular dystrophy-dystroglycanopathy with mental retardation, type B2 |
| 119463989 | POMT2 | NM_013382.5(POMT2):c.1 912C>T (p.Arg638Ter) | CCCAGGTCCTGCTGYGAGGAGGC | Congenital muscular dystrophy-dystroglycanopathy with brain and eye anomalies, type A2 |
| 533916138 | POMT2 | NM_013382.5(POMT2):c.1 006+1G>A | CCCAGAGACACTCAYGTTCAGGG | Congenital muscular dystrophy-dystroglycanopathy with brain and eye anomalies, type A2 |
| 786205099 | POR | NM_000941.2(POR):c.731+ 1G>A | CCAGRTGAGCAAGTGCCCGCAGG | Antley-Bixler syndrome with genital anomalies and disordered steroidogenesis |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 28931607 | POR | NM_000941.2(POR):c.1706 G>A (p.Cys569Tyr) | CGGCTRCCGCGCTCGGATGAGG | Disordered steroidogenesis due to cytochrome p450 oxidoreductase deficiency |
| 104893755 | POU1F1 | NM_001122757.2(POU1F1): c.889C>T (p.Arg297Trp) | CCGGAGGCAGAGAGAGAAAAYGG G | Pituitary hormone deficiency, combined 1 |
| 104893757 | POU1F1 | NM_001122757.2(POU1F1): c.71C>T (p.Pro24Leu) | CCTCTGCAACTCTGCYTCTGATA | Pituitary hormone deficiency, combined 1 |
| 111033345 | POU3F4 | NM_000307.4(POU3F4):c.499C>T (p.Arg167Ter) | CCTGCACCCGTGCTCYGAGAGC | Deafness, X-linked 2 |
| 121909056 | POU4F3 | NM_002700.2(POU4F3):c.865C>T (p.Leu289Phe) | CCGGAAGCGTTCAYTCGAGGC | Deafness, autosomal dominant 15 |
| 72551362 | PPARG | NM_138712.3(PPARG):c.868G>A (p. Val290Met) | TCGCTCCRTGGAGGCTGTGCAGG | Lipodystrophy, familial partial, type 3 |
| 121918325 | PPOX | NM_001122764.1(PPOX):c.502C>T (p.Arg168Cys) | CCATGGACAGTCTCTGCYGTGGA | Variegate porphyria |
| 387907110 | PRDM5 | NM_018699.3(PRDM5):c.1768C>T (p.Arg590Ter) | CCTGAAGAAATGCTGATTYGAC | Brittle cornea syndrome 2 |
| 104894176 | PRF1 | NM_001083116.1(PRF1):c.1122G>A (p.Trp374Ter) | CTCGCTGRAGGACTGCAGCCGG | Hemophagocytic lymphohistiocytosis, familial, 2, Malignant lymphoma, non-Hodgkin |
| 104894180 | PRF1 | NM_001083116.1(PRF1):c.190C>T (p.Gln64Ter) | CCTTCCCAGTGGACACAYAAAGG | Hemophagocytic lymphohistiocytosis, familial, 2 |
| 35418374 | PRF1 | NM_001083116.1(PRF1):c.11G>A (p.Arg4His) | CCCAGGAGGAGCAGAYGGGCTG C, CCAGGAGGAGCAGAYGGGCTGC C | Aplastic anemia |
| 113994140 | PRICKLE1 | NM_153026.2(PRICKLE1): c.311G>A (p. Arg104Gln) | CAGCRGAAGAAAGAAGCACTGG G, TCAGCRGAAGAAAGAAGCACTG G | Progressive myoclonus epilepsy with ataxia |
| 587776773 | PRKAR1A | NM_002734.4(PRKAR1A): c.-7+1G>A | CAGRTGAGTGGGGTCGCCGGG, CCAGRTGAGTGGGGTCGCCGGG, CCCAGRTGAGTGGGGTCGGCCGG | Pigmented nodular adrenocortical disease, primary, 1 |
| 281864780 | PRKAR1A | NM_212472.2(PRKAR1A): c.82C>T (p.Gln28Ter) | CCAGAAGCATAAACATTYAAGCGC | Carney complex, type 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398122958 | PRKCD | NM_006254.3(PRKCD):c.1 352+1G>A | CACRTACGTAAGGGCCATGTGG, TGCCACRTACGTAAGGGCCATGG | Common variable immunodeficiency 9 |
| 121918514 | PRKCG | NM_002739.3(PRKCG):c.3 53G>A (p.Gly118Asp) | ACTGTGRCTCCCTCCTCTACGGG, CACTGTGRCTCCCTCCTCTACGG | Spinocerebellar ataxia 14 |
| 386134164 | PRKCG | NM_002739.3(PRKCG):c.3 67G>A (p.Gly123Arg) | CTCTACRGGCTTGTGCACCAGGG, CCTCTACRGGCTTGTGCACCAGG | Spinocerebellar ataxia 14 |
| 386134165 | PRKCG | NM_002739.3(PRKCG):c.3 68G>A (p.Gly123Glu) | CTCTACGRGCTTGTGCACCAGGG, CCTCTACGRGCTTGTGCACCAGG | Spinocerebellar ataxia 14 |
| 386134167 | PRKCG | NM_002739.3(PRKCG):c.3 92G>A (p.Cys131Tyr) | AATRCTCTGTGAGTGACCTGGG, AAATRCTCTGTGAGTGACCTGG | Spinocerebellar ataxia 14 |
| 386134171 | PRKCG | NM_002739.3(PRKCG):c.1 078G>A (p.Gly360Ser) | AAARGCAGTTTTGGAAGGTTGG, AGGAAAARGCAGTTTTGGGAAG G | Spinocerebellar ataxia 14 |
| 121918511 | PRKCG | NM_002739.3(PRKCG):c.3 01C>T (p.His101Tyr) | CCAGAGACCCCCGGAACAAAYAC A | Spinocerebellar ataxia 14 |
| 142742242 | PROC | NM_000312.3(PROC):c.12 01G>A (p.Asp401Asn) | GGGCRACAGTGGGGGGCCCATG G | Thrombophilia, hereditary, due to protein C deficiency, autosomal dominant |
| 121918149 | PROC | NM_000312.3(PROC):c.22 6G>A (p. Val76Met) | AAAATRTGGATGACACAGTAAGG | Thrombophilia, hereditary, due to protein C deficiency, autosomal recessive |
| 121918144 | PROC | NM_000312.3(PROC):c.90 2C>T (p.Ala301Val) | CCACCGACAATGACATCGYACTG, CCGACAATGACATCGYACTGCTG | Thrombophilia, hereditary, due to protein C deficiency, autosomal recessive |
| 121918160 | PROC | NM_000312.3(PROC):c.93 5C>T (p.Ser312Leu) | CCCAGCCCGCCACCCTCTYGCAG, CCAGCCCGCCACCCTCTYGCAGA | Thrombophilia, hereditary, due to protein C deficiency, autosomal dominant |
| 757583846 | PROC | NM_000312.3(PROC):c.16 9C>T (p.Arg57Trp) | CCGTCACAGCAGCCTGGAGYGGG | Thrombophilia, hereditary, due to protein C deficiency, autosomal dominant |
| 3970559 | PRODH | NM_016335.4(PRODH):c.1 357C>T (p.Arg453Cys) | CACRGGCTCGCTCCTGGGCCAGG, TGCCCACRGGCTCGCTCCTCTGGG | Proline dehydrogenase deficiency, Schizophrenia 4 |
| 376142095 | PROKR2 | NM_144773.2(PROKR2):c. 743G>A (p.Arg248Gln) | CCTTGAACCAGAGTCCYGGGAG | |
| 137853006 | PROM1 | NM_006017.2(PROM1):c.1 117C>T (p.Arg373Cys) | CCTGACAGAGTACAAYGCCAAAC | Bull eye macular dystrophy, Stargardt disease 4, Cone-rod dystrophy 12 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853100 | PROP1 | NM_006261.4(PROP1):c.29 6G>A (p.Arg99Gln) | GGCCCRAGAGAGTCTTGCCCGGG, GGGCCCRAGAGAGTCTTGCCCGG | Pituitary hormone deficiency, combined 2 |
| 121917843 | PROP1 | NM_006261.4(PROP1):c.21 7C>T (p.Arg73Cys) | CCCGCGCCGCCACYGCACCACC | Pituitary hormone deficiency, combined 2 |
| 121917844 | PROP1 | NM_006261.4(PROP1):c.29 5C>T (p.Arg99Ter) | CCCCGACATCTGGGCCYGAGAGA, CCCGACATCTGGGCCYGAGAGAG, CCGACATCTGGGCCYGAGAGAGT | Pituitary hormone deficiency, combined 2 |
| 794727001 | PRPF31 | NM_015629.3(PRPF31):c.1 073+1G>A | CCGCAGRTGAGGGGCCCTGGGG, GCCGCAGRTGAGGGGCCCTGGGG, GGCCCAGRTGAGGGGCCCCTGGG | Retinitis pigmentosa 11 |
| 587777599 | PRPF4 | NM_004697.4(PRPF4):c.94 4C>T (p.Pro315Leu) | CCTTTCCAGTGATGATGAACYAGTGG | Retinitis pigmentosa 70 |
| 61755789 | PRPH2 | NM_000322.4(PRPH2):c.50 0G>A (p.Gly167Asp) | CTGCGRCAACAACGGTTTTCGGG, GCTGCGRCAACAACGGTTTTTCGG | Patterned dystrophy of retinal pigment epithelium, not provided |
| 121918566 | PRPH2 | NM_000322.4(PRPH2):c.94 7G>A (p.Trp316Ter) | GGAGACCTRGAAGGCCTTTCTGG | Macular dystrophy, vitelliform, adult-onset, not provided |
| 527236097 | PRPH2 | NM_000322.4(PRPH2):c.41 0G>A (p.Gly137Asp) | GAAGRCATGAAGTACTACCGGG, AGAACGRCATGAAGTACTACCGG | Retinitis pigmentosa |
| 527236098 | PRPH2 | NM_000322.4(PRPH2):c.49 9G>A (p.Gly167Ser) | CTGCGRCAACAACGGTTTTCGGG, GCTGCGRCAACAACGGTTTTTCGG | Retinitis pigmentosa |
| 61755771 | PRPH2 | NM_000322.4(PRPH2):c.13 6C>T (p.Arg46Ter) | CCTGAAGATTGAACTCYGAAAGA | Retinitis pigmentosa 7, not provided |
| 61755806 | PRPH2 | NM_000322.4(PRPH2):c.64 7C>T (p.Pro216Leu) | CCTTTCAGCTGCTGCAATCYTAG | Retinitis pigmentosa 7, not provided |
| 387907125 | PRRT2 | NM_145239.2(PRRT2):c.95 0G>A (p.Ser317Asn) | TAARCATCTGGGCGCTGGTGGG, TTAARCATCGTGGGCTGGTGGG, CTTAARCATCGTGGCGCTGGTGG, GCTCTTAARCATCGTGGCGCTGG | Infantile convulsions and paroxysmal choreoathetosis, familial |
| 397514579 | PRRT2 | NM_145239.2(PRRT2):c.74 8C>T (p.Gln250Ter) | CCGCACCCCAGCTCCYAGTTGG | Dystonia 10, Seizures, benign familial infantile, 2 |
| 387907127 | PRRT2 | NM_145239.2(PRRT2):c.48 7C>T (p.Gln163Ter) | CCAGAGCTCCTACCYAGGAGGA | Dystonia 10, Infantile convulsions and paroxysmal choreoathetosis, familial, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 730882158 | PRSS56 | NM_001195129.1(PRSS56): c.958G>A (p.Gly320Arg) | GCCCRGGGTCTACACCGCGCTGG | Microphthalmia, isolated 6 |
| 3814290 | PRX | NM_181882.2(PRX):c.1951 G>A (p.Asp651Asn) | TGTGCCCRATGTGCACCTCCCGG | Charcot-Marie-Tooth disease, type IVF, not provided |
| 104894708 | PRX | NM_181882.2(PRX):c.3208 C>T (p.Arg1070Ter) | CCTTCCTTTGGGCTGGCTYGAGG, CCTTTGGGCTGGCTYGAGGGAAG | Dejerine-Sottas disease, Charcot-Marie-Tooth disease, type IVF |
| 121917807 | PSEN1 | NM_000021.3(PSEN1):c.79 6G>A (p.Gly266Ser) | GAAARGTCCACTTCCTATGCTGG | Alzheimer disease, familial, 3, with spastic paraparesis and apraxia |
| 63750577 | PSEN1 | NM_000021.3(PSEN1):c.50 9C>T (p.Ser170Phe) | CCTGCTTATTATATCATTYCTA | Alzheimer disease, type 3, not provided |
| 63750048 | PSEN2 | NM_000447.2(PSEN2):c.25 4C>T (p.Ala85Val) | CCCTCAAATACGGAGYGAAGCAC, CCTCAAATACGGAGYGAAGCAC G | Alzheimer disease, type 4, not provided |
| 138911275 | PTCH1 | NM_000264.3(PTCH1):c.3 155C>T (p.Thr1052Met) | CGGGCCRTCCAGGGGTTCAGAAGG | Gorlin syndrome, Holoprosencephaly sequence, Holoprosencephaly 7, not specified, not provided |
| 199476091 | PTCH1 | NM_000264.3(PTCH1):c.1 177G>A (p.Ala393Thr) | CAAAGCGRCAGCCATCCTGGAGG | Holoprosencephaly 7 |
| 587776628 | PTCH2 | NM_003738.4(PTCH2):c.3 357+5C>T | GTGTGRTCACCTCTGGCGGCGGG, GGTGTGRTCACCTCTGGCGCGG | |
| 587776674 | PTEN | NM_000314.6(PTEN):c.- 764G>A | GCGAGRGAGATGAGAGACGCG G, CAGGCGAGRGAGATGAGAGACG G | Cowden syndrome 1, not specified |
| 121909234 | PTEN | NM_000314.6(PTEN):c.649 G>A (p. Val217Ile) | GTTTGTGRTCTGCCAGCTAAAGG | Malignant melanoma |
| 786204859 | PTEN | NM_000314.6(PTEN):c.407 G>A (p.Cys136Tyr) | TATRTGCATATTTATTACATCGG | Hereditary cancer-predisposing syndrome |
| 587781255 | PTEN | NM_000314.6(PTEN):c.379 G>A (p.Gly127Arg) | AAAGCTRGAAAGGACGAACTG G | PTEN hamartoma tumor syndrome |
| 202004587 | PTEN | NM_000314.6(PTEN):c.235 G>A (p.Ala79Thr) | ACCRCCAAATTTAATTGCAGAGG | PTEN hamartoma tumor syndrome, Hereditary cancer-predisposing syndrome, not specified, not provided |
| 786204856 | PTEN | NM_000314.6(PTEN):c.284 C>T (p.Pro95Leu) | CCTTTTGAGACCATAACCYACC | Hereditary cancer-predisposing syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909219 | PTEN | NM_000314.6(PTEN):c.697 C>T (p.Arg233Ter) | CCAATTCAGGACCCACAYGACGG | Bannayan-Riley-Ruvalcaba syndrome, PTEN hamartoma tumor syndrome, Cowden syndrome 1, Hereditary cancer-predisposing syndrome |
| 121434604 | PTH1R | NM_000316.2(PTH1R):c.3 10C>T (p.Arg104Ter) | CCCACTGGCAGCAGGTACYGAGG, CCACTGGCAGCAGGTACYGAGGT | Chondrodysplasia Blomstrand type |
| 397507541 | PTPN11 | NM_002834.3(PTPN11):c.1 492C>T (p.Arg498Trp) | CCATCCAGATGGTGYGGTCTCAG | Noonan syndrome 1, LEOPARD syndrome 1, Rasopathy |
| 121434507 | PTPRJ | NM_002843.3(PTPRJ):c.64 0C>T (p.Arg214Cys) | CCCAGTTTCTGATCTCYGTGTTG, CCAGTTTCTGATCTCYGTGTGC | Carcinoma of colon |
| 104894273 | PTS | NM_000317.2(PTS):c.74G>A (p.Arg25Gln) | AGCCACCRATTGTACAGGTAGGG, GAGCCACCRATTGTACAGGTAGG | 6-pyruvoyl-tetrahydropterin synthase deficiency |
| 104894274 | PTS | NM_000317.2(PTS):c.46C>T (p.Arg16Cys) | CCAGGCACAAGTGTCCYGCCGCA | Hyperphenylalaninemia, bh4-deficient, a, due to partial pts deficiency |
| 398123001 | PUF60 | NM_078480.2(PUF60):c.50 5C>T (p.His169Tyr) | CCGTCACCATGAAGYACAAGGTC | Verheij syndrome |
| 587782993 | PURA | NM_005859.4(PURA):c.55 6C>T (p.Gln186Ter) | CCTGGGCTCCACGCAGGGCYAGA | Neonatal hypotonia, Intellectual disability, Seizures, Delayed speech and language development, Global developmental delay, Mental retardation, autosomal dominant 31 |
| 104894371 | PUS1 | NM_001002020.2(PUS1):c.346C>T (p.Arg116Trp) | CCTTCCAGCGCTGCGCCYGGACA | Myopathy, lactic acidosis, and sideroblastic anemia 1 |
| 104894281 | PVRL1 | NM_203285.1(PVRL1):c.5 54G>A (p.Trp185Ter) | TCCTRGGAAACTCGGTTAAAAGG | Orofacial cleft 7, Cleft lip/palate-ectodermal dysplasia syndrome |
| 267606992 | PVRL4 | NM_030916.2(PVRL4):c.5 54C>T (p.Thr185Met) | CCCAGCGTGACCTGGGACAYGGA, CCAGCGTGACCTGGGACAYGGAG | Ectodermal dysplasia-syndactyly syndrome 1 |
| 587777572 | PXDN | NM_012293.2(PXDN):c.26 38C>T (p.Arg880Cys) | AGCRCAGAAGAACATGCAGCAG G | Sclerocornea, autosomal recessive |
| 113993984 | PYGL | NM_002863.4(PYGL):c.20 17G>A (p.Glu673Lys) | GGCACCRAAGCCTCGGGGACAG G | Glycogen storage disease, type VI |
| 116987552 | PYGM | NM_005609.2(PYGM):c.14 8C>T (p.Arg50Ter) | CTCRTGGGTGGCCACATTGCGG | Glycogen storage disease, type V, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 144081869 | PYGM | NM_005609.2(PYGM):c.20 56G>A (p.Gly686Arg) | CCAATGGTCAGAGACCCYGTTGAG | Glycogen storage disease, type V |
| 116315896 | PYGM | NM_005609.2(PYGM):c.64 5G>A (p.Lys215=) | CCTGTGTCCACCCAYTTGGCA | Glycogen storage disease, type V, not specified |
| 104893863 | QDPR | NM_000320.2(QDPR):c.68 G>A (p.Gly23Asp) | TCTGRTTCTCGATGCGTGCAGG | Dihydropteridine reductase deficiency |
| 587776734 | RAB39B | NM_171998.3(RAB39B):c. 215+1G>A | CCCGGACTGCGCTCCCAYCTGAA, CCGGACTGCGCCTCCCAYCTGAAC | Mental retardation, X-linked 72 |
| 587777167 | RAB3GA P2 | NM_012414.3(RAB3GAP2): c.1276C>T (p.Arg426Cys) | CGCRGTACCCTTAGAGACAGAGG | Martsolf syndrome |
| 587777169 | RAB3GA P2 | NM_012414.3(RAB3GAP2): c.3637C>T (p.Arg1213Ter) | TGTCRTACAGAAATAAAATTTGG | Warburg micro syndrome 2 |
| 587777168 | RAB3GA P2 | NM_012414.3(RAB3GAP2): c.1434G>A (p.Trp478Ter) | CCCTGCTGTGTGCTYCACACTTC | Warburg micro syndrome 2 |
| 74315507 | RAC2 | NM_002872.4(RAC2):c.16 9G>A (p.Asp57Asn) | GTGGRACACTGCTGGGCAGGAGG, GCTGTGGRACACTGCTGGGCAGG | Neutrophil immunodeficiency syndrome |
| 121917739 | RAD51 | NM_002875.4(RAD51):c.4 49G>A (p.Arg150Gln) | ATTGACCRGGGTGGAGGTGAAGG | Familial cancer of breast |
| 267606997 | RAD51C | NM_058216.2(RAD51C):c. 773G>A (p.Arg258His) | CTTCRTACTCGGTTATTAAATGG | Fanconi anemia, complementation group O, Hereditary cancer-predisposing syndrome |
| 104894284 | RAG1 | NM_000448.2(RAG1):c.16 82G>A (p.Arg561His) | GTTCCRCTATGATTCAGCTTTGG | Histiocytic medullary reticulosis |
| 104894285 | RAG1 | NM_000448.2(RAG1):c.16 81C>T (p.Arg561Cys) | CCAATTGCAAAGAGGTTCYGCTAT | Histiocytic medullary reticulosis |
| 104894298 | RAG1 | NM_000448.2(RAG1):c.15 19C>T (p.Arg507Trp) | CCTTTGCATGCCCCTTYGGAATGC | Combined cellular and humoral immune defects with granulomas |
| 121918573 | RAG2 | NM_000536.3(RAG2):c.14 33G>A (p.Cys478Tyr) | GTATTACTRCAATGAGCATGTGG | |
| 104894633 | RAI1 | NM_030665.3(RAI1):c.542 3G>A (p.Ser1808Asn) | TGAGTGCARCAAGGAGGCTCCGG | Smith-Magenis syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 527236033 | RAI1 | NM_030665.3(RAI1):c.2273G>A (p.Trp758Ter) | CCCAGGTRGGGATTGCACCCTGG | Smith-Magenis syndrome |
| 104894294 | RAPSN | NM_005055.4(RAPSN):c.490C>T (p.Arg164Cys) | CCATGCTCGAGTGCYGCGTGTGC | MYASTHENIC SYNDROME, CONGENITAL, 11, ASSOCIATED WITH ACETYLCHOLINE RECEPTOR DEFICIENCY |
| 121909127 | RAX | NM_013435.2(RAX):c.575G>A (p.Arg192Gln) | GTGGCRGCGCAGGAGAAGCTGG | Microphthalmia, isolated 3 |
| 121908280 | RAX2 | NM_032753.3(RAX2):c.260G>A (p.Arg87Gln) | GAGCRGCTGAGTCAGGCTCGGG, GGAGCRGCTGAGTCAGGCTCGG | Age-related macular degeneration 6 |
| 587778838 | RB1 | NM_000321.2(RB1):c.2490-1G>A | GACARAATCTTAGTATATCAATTGG | Retinoblastoma |
| 587778842 | RB1 | NM_000321.2(RB1):c.763C>T (p.Arg255Ter) | CCTCGAACACCCAGGYGAGGTCA | Retinoblastoma, not provided |
| 587778869 | RB1 | NM_000321.2(RB1):c.103C>T (p.Gln35Ter) | CCTGAGGAGGACCCAGAGYAGGA | Retinoblastoma, not provided |
| 137853293 | RB1 | NM_000321.2(RB1):c.2359C>T (p.Arg787Ter) | CCAATACCTCACATTCCTYGAAG | Retinoblastoma, not provided |
| 727503762 | RBCK1 | NM_031229.2(RBCK1):c.553C>T (p.Gln185Ter) | CCAGGAAACCCGGACGGGGYAGC | Polyglucosan body myopathy 1 with or without immunodeficiency |
| 267607000 | RBM10 | NM_005676.4(RBM10):c.1235G>A (p.Trp412Ter) | GGCCCAGTRGGCCATCTCACAGG | TARP syndrome |
| 267607001 | RBM20 | NM_001134363.2(RBM20):c.1901G>A (p.Arg634Gln) | AAGGCCGCRGTCTCGTAGTCCGG | Dilated cardiomyopathy 1DD, Cardiomyopathy |
| 267607004 | RBM20 | NM_001134363.2(RBM20):c.1907G>A (p.Arg636His) | GGTCTCRTAGTCCGGTGAGCCGG | Primary dilated cardiomyopathy, Dilated cardiomyopathy 1DD, Cardiomyopathy |
| 267607003 | RBM20 | NM_001134363.2(RBM20):c.1913C>T (p.Pro638Leu) | CCGCGGTCTCGTAGTCYGGTGAG | Dilated cardiomyopathy 1DD, Cardiomyopathy |
| 146150511 | RBP3 | NM_002900.2(RBP3):c.3238G>A (p.Asp1080Asn) | CCACTGACCTCATGTYGATGATC | Retinitis pigmentosa 66 |
| 386834260 | RD3 | NM_183059.2(RD3):c.296+1G>A | CTCAGRTGAGCACTGGGATGGGG, CCTCAGRTGAGCACTGGGATGGG, TCCTCAGRTGAGCACTGGGATGG | Leber congenital amaurosis 12 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906272 | RDH12 | NM_152443.2(RDH12):c.58+1G>A | CAAGRTAAGTCTGGAGAAAGAGG | Leber congenital amaurosis 13 |
| 104894470 | RDH12 | NM_152443.2(RDH12):c.65C>T (p.Gln189Ter) | CCCTTCCACGACCTCYAGAGCGA, CCTTCCACGACCTCYAGAGCGAG | Leber congenital amaurosis 13 |
| 104894471 | RDH12 | NM_152443.2(RDH12):c.184C>T (p.Arg62Ter) | CCAGAGAGCTCGCTAGCYGAGGT | Leber congenital amaurosis 13 |
| 121434337 | RDH12 | NM_152443.2(RDH12):c.464C>T (p.Thr155Ile) | CCACTTCCTCCTCAYCTACCTGC | Leber congenital amaurosis 13 |
| 117642173 | RECQL4 | NM_004260.3(RECQL4):c.1391-1G>A | CCTCAGCCCGGCTCTYTGCAGAC | Rothmund-Thomson syndrome |
| 386833851 | RECQL4 | NM_004260.3(RECQL4):c.2476C>T (p.Arg826Ter) | CCTGCAGGGCGAAGACCTGYGAG | Rothmund-Thomson syndrome, Rapadilino syndrome, not provided |
| 760363252 | RECQLA | NM_004260.3(RECQL4):c.1704+1G>A | CCCATGAGGCCCCCAYCTTCTGC, CCATGAGGCCCCCAYCTTCTGCA | Rothmund-Thomson syndrome |
| 137853229 | RECQL4 | NM_004260.3(RECQL4):c.2269C>T (p.Gln757Ter) | CCGGGAACGCGGCGGGTAYAGC | Rothmund-Thomson syndrome |
| 121917740 | REN | NM_000537.3(REN):c.1159C>T (p.Arg387Ter) | CCTGGGGGCCACCTTCATCYGAA | Renal dysplasia |
| 121917741 | REN | NM_000537.3(REN):c.145C>T (p.Arg49Ter) | CCGAGAAAGCCTGAAGGAYGAG | Renal dysplasia |
| 118203913 | RFT1 | NM_052859.3(RFT1):c.199C>T (p.Arg67Cys) | CCTGGCCAGAGAGGCCTTCYGCA, CCAGAGAGGCCTTCYGCAGAGCA | Congenital disorder of glycosylation type 1N |
| 137853099 | RFX5 | NM_000449.3(RFX5):c.446G>A (p.Arg149Gln) | GCTCRAAGGCTTGGTGGCCGGG, AGCTCRAAGGCTTGTGGCCGGG, AAGCTCRAAGGCTTGGTGGCCGG | Bare lymphocyte syndrome type 2, complementation group E |
| 267607013 | RFX6 | NM_173560.3(RFX6):c.542G>A (p.Arg181Gln) | ACAAGGCRGCTTGGAACAAGAG | Mitchell-Riley syndrome |
| 121918587 | RHAG | NM_000324.2(RHAG):c.836G>A (p.Gly279Glu) | CTTGCTGRAGGAGTTGCTGTGGG, CCTTGCTGRAGGAGTTGCTGTGG | |
| 387907130 | RHBDF2 | NM_024599.5(RHBDF2):c.566C>T (p.Pro189Leu) | CCCTTCCAGATTGTGGATCYGCT, CCTTCCAGATTGTGATCYGCTG, CCAGATTGTGGATCYGCTGCCC | Howel-Evans syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893780 | RHO | NM_000539.3(RHO):c.544 G>A (p.Gly182Ser) | GAGRGCCTGCAGTGCTCGTGTGG | Retinitis pigmentosa 4 |
| 527236103 | RHO | NM_000539.3(RHO):c.520 G>A (p.Gly174Ser) | TCGCCRGCTGGTCCAGGTAATGG | Retinitis pigmentosa 4 |
| 104893769 | RHO | NM_000539.3(RHO):c.50C>T (p.Thr17Met) | CCCTTCTCCAATGCGAYGGGTGT, CCTTCTCCAATGCGAYGGGTGTG | Retinitis pigmentosa 4 |
| 104893778 | RHO | NM_000539.3(RHO):c.1030C>T (p.Gln344Ter) | CCAAGACGGAGACGAGCYAGGTG | Retinitis pigmentosa 4 |
| 104893781 | RHO | NM_000539.3(RHO):c.800 C>T (p.Pro267Leu) | CCTGATCTGCTGGGTGCYCTACG | Retinitis pigmentosa 4 |
| 104893794 | RHO | NM_000539.3(RHO):c.511 C>T (p.Pro171Ser) | CCTCGCGCCGCCACCCYCACTCGCC | Retinitis pigmentosa 4 |
| 76857106 | RNASEH2A | NM_006397.2(RNASEH2A):c.109G>A (p.Gly37Ser) | GCGRGCAGGGGCCCCGTGCTGGG, GGCCRGCAGGGGCCCCGTGCTGG | Aicardi Goutieres syndrome 4 |
| 75718910 | RNASEH2A | NM_006397.2(RNASEH2A):c.704G>A (p.Arg235Gln) | TGTCCRGTTCAGCTGGCGCACGG | Aicardi Goutieres syndrome 4 |
| 397515479 | RNASEH2A | NM_006397.2(RNASEH2A):c.75C>T (p.Arg25=) | CCCGCGGGTGCCGYAAGGAGCC | Aicardi Goutieres syndrome 4 |
| 786201014 | RNF125 | NM_017831.3(RNF125):c.336G>A (p.Met112Ile) | GTGAAATRAGGGCACATATTCGG | TENORIO SYNDROME |
| 370242930 | RNF125 | NM_017831.3(RNF125):c.520C>T (p.Arg174Cys) | CCAGTTCTGTCCACTTTGCYGTT | TENORIO SYNDROME |
| 121918162 | RNF135 | NM_032322.3(RNF135):c.857G>A (p.Arg286His) | ACCRCCCACAACCCTATCGCTGG | Macrocephaly, macrosomia, facial dysmorphism syndrome |
| 397514478 | RNF170 | NM_001160223.1(RNF170):c.595C>T (p.Arg199Cys) | CCTTTTCTGATGTTTYGCATCA | Ataxia, sensory, autosomal dominant |
| 121918278 | ROBO3 | NM_022370.3(ROBO3):c.2317C>T (p.Gln773Ter) | CCCCAGTGGCCCCCAYAGGGA, CCCAGTGGGCCCCAYAGGGAG, CCCAGTGGCCCCCAYAGGGAGT, CCAGTGGCCCCCAYAGGGAGTG | Gaze palsy, familial horizontal, with progressive scoliosis |
| 121909083 | ROR2 | NM_004560.3(ROR2):c.1504C>T (p.Gln502Ter) | CCCCGGGGAGCAGACCYAGGCT, CCCGGGGAGCAGACCYAGGCT | Robinow syndrome, autosomal recessive |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909084 | ROR2 | NM_004560.3(ROR2):c.55 0C>T (p.Arg184Cys) | G, CCGGGGAGCAGACCYAGGCTG T | Robinow syndrome, autosomal recessive |
| 267607016 | ROR2 | NM_004560.3(ROR2):c.13 24C>T (p.Arg442Ter) | CCGGGGAATTGCCTGTGCAYGCT | Robinow syndrome, autosomal recessive, with brachy-syn-polydactyly |
| 104894927 | RP2 | NM_006915.2(RP2):c.358C >T (p.Arg120Ter) | CCACACCCGCAGCGYGGYGACAGCTG | Retinitis pigmentosa 2 |
| 61751281 | RPE65 | NM_000329.2(RPE65):c.11 8G>A (p.Gly40Ser) | CCAACAATTCGTGTGYGAGATT | Retinitis pigmentosa, not provided |
| 61752871 | RPE65 | NM_000329.2(RPE65):c.27 1C>T (p.Arg91Trp) | ACCRCAGTCTCCTTCGATGTGG | Retinitis pigmentosa 20, not provided |
| 62638651 | RPGR | NM_000328.2(RPGR):c.70 3C>T (p.Pro235Ser) | CCGCACTGATGCTTACGTAYGGG | Retinitis pigmentosa 15, not provided |
| 121918204 | RPGRIP1 L | NM_015272.3(RPGRIP1L): c.2050C>T (p.Gln684Ter) | CCTGGGCAATCACAGAACAYCCC | Joubert syndrome 7 |
| 121918591 | RPIA | NM_144563.2(RPIA):c.404 C>T (p.Ala135Val) | CCCTTGAGGTCCACYAGGCTTAT | Deficiency of ribose-5-phosphate isomerase |
| 587777527 | RPL21 | NM_000982.3(RPL21):c.95 G>A (p.Arg32Gln) | CCCTGTCCTCCGCAGGYCCGCCA, CCTGTCCTCCGCAGGYCCGCCAG | Hypotrichosis 12 |
| 786200936 | RPS19 | NM_001022.3(RPS19):c.38 0G>A (p.Gly127Glu) | TATATGCRAATCTATAAGAAAGG | Diamond-Blackfan anemia 1 |
| 104894711 | RPS19 | NM_001022.3(RPS19):c.18 4C>T (p.Arg62Trp) | ACCTCAGGRACAAAGAGATCTGG | Diamond-Blackfan anemia 1 |
| 61762293 | RPS19 | NM_001022.3(RPS19):c.28 0C>T (p.Arg94Ter) | CCCCCAGCTTCCACAGCGYGGCA, CCCCAGCTTCCACAGCGYGGCAC, CCAGCTTCCACAGCGYGGCACC, CCAGCTTCCACAGCGYGGCACCT | Diamond-Blackfan anemia 1 |
| 148622862 | RPS26 | NM_001029.3(RPS26):c.3+ 1G>A | CCAGCCACTTCAGCYGAGGCTC, CCAGCCACTTCAGCYGAGGCTCC | Diamond-Blackfan anemia 10 |
| 122454128 | RPS6KA3 | NM_004586.2(RPS6KA3):c. 2065C>T (p.Gln689Ter) | AGATGRTGAGTCTTCTTGCCTGG | Coffin-Lowry syndrome |
| | | | CCAACTGCCACAATACYAACTAA | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397507554 | RPS7 | NM_001011.3(RPS7):c.147 +1G>A | AAGRTAAGCTGGCGCTCCCTCGG | Diamond-Blackfan anemia 8 |
| 397514759 | RPSA | NM_002295.5(RPSA):c.25 C>T (p.Gln9Ter) | CCCTTGATGTCCTGYAAATGAAG | Splenic hypoplasia |
| 515726181 | RRM2B | NM_015713.4(RRM2B):c.1 21C>T (p.Arg41Trp) | ACCRGCGAGAACTCTTTCTTAGG | RRM2B-related mitochondrial disease |
| 267607025 | RRM2B | NM_015713.4(RRM2B):c.3 29G>A (p.Arg110His) | GGTGGAGCRCTTTAGTCAGGAGG | Mitochondrial DNA depletion syndrome 8B (MNGIE type), RRM2B-related mitochondrial disease |
| 515726192 | RRM2B | NM_015713.4(RRM2B):c.5 83G>A (p.Gly195Arg) | CCTGAGAAGAAAACTCYTTCTAC | RRM2B-related mitochondrial disease |
| 515726195 | RRM2B | NM_015713.4(RRM2B):c.6 32G>A (p.Arg211Lys) | CCTGGCATAAGACCTYTCTTCTT | RRM2B-related mitochondrial disease |
| 200382776 | RSPH1 | NM_080860.3(RSPH1):c.72 7+5G>A (p.Ala244ValfsTer22) | CCACAGCCCGGGGGTGCCCYACA | Kartagener syndrome |
| 587777635 | RSPH1 | NM_080860.3(RSPH1):c.28 1G>A (p.Trp94Ter) | CCGCAGGTCATTTGCCYACTCTC | Primary ciliary dyskinesia 24 |
| 118204041 | RSPH4A | NM_001010892.2(RSPH4A): c.460° C.>T (p.Gln154Ter) | CCTTTCAACAGTCTYAGCAACCC | Ciliary dyskinesia, primary, 11 |
| 118204042 | RSPH4A | NM_001010892.2(RSPH4A): c.325C>T (p.Gln109Ter) | CCTCGCGGCACCACCTYAGTCGG | Ciliary dyskinesia, primary, 11 |
| 74315423 | RSPO4 | NM_001029871.3(RSPO4): c.218G>A (p.Cys73Tyr) | GACTRTCCCCCTGGGTACTTCGG | Anonychia |
| 387907027 | RSPO4 | NM_001029871.3(RSPO4): c.190C>T (p.Arg64Cys) | CCGCCGGGAAGGCATCYGCCAGT | Anonychia |
| 397515537 | RUNX2 | NM_001024630.3(RUNX2): c.1171C>T (p.Arg391Ter) | CCGCTTCTCCAACCAYGAATGC | Cleidocranial dysostosis |
| 193922802 | RYR1 | NM_000540.2(RYR1):c.70 48G>A (p.Ala2350Thr) | AGAACRCCAATGTGGTGCGG | Malignant hyperthermia susceptibility type 1, not provided |
| 193922879 | RYR1 | NM_000540.2(RYR1):c.14 524G>A (p.Val4842Met) | GACCRTGGGCCTTCTGGCGTGG, GATGACCRTGGGCCTTCTGGCGG | Minicore myopathy with external ophthalmoplegia, Myopathy, congenital with cores, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794727982 | RYR1 | NM_000540.2(RYR1):c.12 612G>A (p.Trp4204Ter) | GTGRGAGATGCCCAGGTCAGGG, AGTGRGAGATGCCCAGGTCAGG | Malignant hyperthermia susceptibility type 1, Central core disease |
| 121918594 | RYR1 | NM_000540.2(RYR1):c.73 73G>A (p.Arg2458His) | CCTCRCTCCCTTGTGCCCTTGG | Malignant hyperthermia susceptibility type 1, Central core disease, not provided |
| 118192183 | RYR1 | NM_000540.2(RYR1):c.14 696G>A (p.Gly4899Glu) | AGGGCATTGRGGACGAGATCGAG G | Central core disease, not provided |
| 118192125 | RYR1 | NM_000540.2(RYR1):c.88 16G>A (p.Arg2939Lys) | GTTACAARGCACGCGGGTTGGGG, GGTTACAARGCACGCGGGTTGGG | Central core disease, not provided |
| 118192168 | RYR1 | NM_000540.2(RYR1):c.14 545G>A (p.Val4849Ile) | GGTCRTCTACCTGTACACCGTGG | Minicore myopathy with external ophthalmoplegia, not provided |
| 193922781 | RYR1 | NM_000540.2(RYR1):c.51 83C>T (p.Ser1728Phe) | CCTGCCGCAGCCCGCCTYCATG, CCGCAGCCCGCCGCCTYCATGCTCT | Malignant hyperthermia susceptibility type 1, not provided |
| 148772854 | RYR1 | NM_000540.2(RYR1):c.11 941C>T (p.His3981Tyr) | CCAGCAGAGCCTGGCGYACAGTC | Minicore myopathy with external ophthalmoplegia, not specified |
| 118192147 | RYR1 | NM_000540.2(RYR1):c.14 659C>T (p.His4887Tyr) | CCCTTCAGTGTTACCTGTTTYACA, CCTTCAGTGTTACCTGTTTYACAT | Central core disease, not provided |
| 118192164 | RYR1 | NM_000540.2(RYR1):c.10 579C>T (p.Pro3527Ser) | CCTGAATATGTGTGCGYCCACCG | not provided |
| 118192173 | RYR1 | NM_000540.2(RYR1):c.32 5C>T (p.Arg109Trp) | CCATGCCATCCTGTCTCYGGCATG | Minicore myopathy with external ophthalmoplegia, not provided |
| 118192181 | RYR1 | NM_000540.2(RYR1):c.14 581C>T (p.Arg4861Cys) | CCTTCAACTTCTTCYCGCAAGTTC | Central core disease, not provided |
| 587784376 | RYR1 | NM_000540.2(RYR1):c.42 25C>T (p.Arg1409Ter) | CCACCCCCACGCTGCCCYGACTC, CCCCCACGCTGCCCCYGACTCCCT | not provided |
| 118192134 | RYR1 | NM_000540.2(RYR1):c.13 910C>T (p.Thr4637Ile) | CCTGGAGGAAAGCAYAGGCTAC A | Central core disease, not provided |
| 118192140 | RYR1 | NM_000540.2(RYR1):c.14 126C>T (p.Thr4709Met) | CCGACTGGTGCTCAACAYGCCGT | Minicore myopathy with external ophthalmoplegia, Central core disease, not provided |
| 794728710 | RYR2 | NM_001035.2(RYR2):c.68 9G>A (p.Gly230Asp) | TCATTGRTGTGATGTCCTCAGG | not provided |
| 794728805 | RYR2 | NM_001035.2(RYR2):c.14 465G>A (p.Arg4822His) | TTCRTGCTGAGGAGGGATCGGG, GTTCRTGCTGAGGAGGGATCGG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794728754 | RYR2 | NM_001035.2(RYR2):c.71 60C>T (p.Ala238Val) | CCCCATGGGAACGYGATCATGA | not provided |
| 121918600 | RYR2 | NM_001035.2(RYR2):c.13 489C>T (p.Arg4497Cys) | CCCTCAGAACTATTTGCTYGCA, CCTCAGAACTATTTGCTYGCAA | Catecholaminergic polymorphic ventricular tachycardia |
| 764698152 | RYR2 | NM_001035.2(RYR2):c.12 40C>T (p.Arg414Cys) | CCCAGCATGAAGAATCAYGCACA, CCAGCATGAAGAATCAYGCACAG | not provided |
| 79681911 | SAA1 | NM_000331.4(SAA1):c.269 G>A (p.Gly90Asp) | CCATGRTGCGGAGGACTCGCTGG | not provided |
| 281865119 | SACS | NM_014363.5(SACS):c.109 07G>A (p.Arg3636Gln) | GAACRAATGGATTTGTTATCTGG | Spastic ataxia Charlevoix-Saguenay type |
| 281865120 | SACS | NM_014363.5(SACS):c.121 60C>T (p.Gln4054Ter) | CCTGCTTTGAAAAGCTTYAAACA | Spastic ataxia Charlevoix-Saguenay type |
| 587777209 | SAG | NM_000541.4(SAG):c.523 C>T (p.Arg175Ter) | CCCACAGGAGCTCCGTGYGATTA, CCACAGGAGCTCCGTGYGATTAC | Oguchi disease |
| 104894538 | SALL1 | NM_002968.2(SALL1):c.96 7C>T (p.Gln323Ter) | CCCCAATCCAGCTACCTYAGAG, CCCCAATCCAGCTACCTYAGAGC, CCAATCCAGCTACCTYAGAGCA, CCAATCCAGCTACCTYAGAGCAG | Townes-Brocks-branchiootorenal-like syndrome |
| 515726145 | SAMHD1 | NM_015474.3(SAMHD1):c. 434G>A (p.Arg145Gln) | CCCAGCTGTTTGATGTATYGAAG, CCAGCTGTTTGATGTATYGAAGA | Aicardi Goutieres syndrome 5 |
| 267607027 | SAMHD1 | NM_015474.3(SAMHD1):c. 490C>T (p.Arg164Ter) | CCAGGAGCTTCACACAATYGATT | Aicardi Goutieres syndrome 5 |
| 121434517 | SAMHD1 | NM_015474.3(SAMHD1):c. 433C>T (p.Arg145Ter) | CCTCAATTTCAACGTCTTYGATA | Aicardi Goutieres syndrome 5 |
| 121434519 | SAMHD1 | NM_015474.3(SAMHD1):c. 1642C>T (p.Gln548Ter) | CCAGAGAAATTTGCAGAGYAGCT | Aicardi Goutieres syndrome 5 |
| 200053119 | SCARB2 | NM_005506.3(SCARB2):c. 361C>T (p.Arg121Ter) | TTGGTCTCRTTCAAAAACATAGG | not provided |
| 387907086 | SCARF2 | NM_153334.6(SCARF2):c. 773G>A (p.Cys258Tyr) | GGCACGTRTGCCTGCGAGCCGGG, CGGCACGTRTGCCTGCGAGCCGG | Marden Walker like syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 138607170 | SCN11A | NM_001287223.1(SCN11A): c.673C>T (p.Arg225Cys) | AACACACRGAAGGTACGCAGGG, GAACACACRGAAGGTACGCAGGG | Episodic pain syndrome, familial, 3 |
| 794726716 | SCN1A | NM_001165963.1(SCN1A): c.2876G>A (p.Cys959Tyr) | TGGGACTRTATGGAGGTTGCTGG | Severe myoclonic epilepsy in infancy |
| 794726824 | SCN1A | NM_001165963.1(SCN1A): c.965-1G>A | AACARGATATCATTATTCCTGG | Severe myoclonic epilepsy in infancy, not provided |
| 794726828 | SCN1A | NM_001165963.1(SCN1A): c.2929G>A (p.Val977Met) | CATGTGATTGGAAACCTAGTGG | Severe myoclonic epilepsy in infancy |
| 796052972 | SCN1A | NM_001165963.1(SCN1A): c.1153G>A (p.Glu385Lys) | CTGGRAAAATCTTTATCAACTGG | not provided |
| 121917957 | SCN1A | NM_006920.4(SCN1A):c.1 130G>A (p.Arg37Gln) | CTTGTTTCRACTAATGACTCAGG | Severe myoclonic epilepsy in infancy, Generalized epilepsy with febrile seizures plus, type 1, not provided |
| 121917971 | SCN1A | NM_006920.4(SCN1A):c.2 804G>A (p.Arg935His) | TCCVCGTGCTGTGTGGGAGTGG, TGTGTTCCVCGTGCTGTGTGGGG | Severe myoclonic epilepsy in infancy |
| 398123588 | SCN1A | NM_006920.4(SCN1A):c.2 543C>A (p.Arg848His) | TGTTCTCCRTTCATTTCGATTGG | Severe myoclonic epilepsy in infancy, Generalized epilepsy with febrile seizures plus, type 2 |
| 763400390 | SCN1A | NM_001165963.1(SCN1A): c.2177-1G>T | CCTGGATTCTTCAAGTTHTAGAT | not provided |
| 794726736 | SCN1A | NM_001165963.1(SCN1A): c.1738C>T (p.Arg580Ter) | CCTTTTCAGCTTTAGAGGGYGAG | Severe myoclonic epilepsy in infancy |
| 794726766 | SCN1A | NM_001165963.1(SCN1A): c.2303C>T (p.Pro768Leu) | CCTGGTTTGATGGACCYATTTG | Severe myoclonic epilepsy in infancy |
| 794726778 | SCN1A | NM_001165963.1(SCN1A): c.1834C>T (p.Arg612Ter) | CCTTGTTTGTGCCCYGACGACAC | Severe myoclonic epilepsy in infancy |
| 796052955 | SCN1A | NM_001165963.1(SCN1A): c.311C>T (p.Ala104Val) | CCATCTTCCGGTTCAGTGYCACC | not provided |
| 796053089 | SCN1A | NM_001165963.1(SCN1A): c.314C>T (p.Thr105Ile) | CCGGTTCAGTGCCAVCTCTGCCC | not provided |
| 121917984 | SCN1A | NM_006920.4(SCN1A):c.6 77C>T (p.Thr226Met) | CCGAGCATTGAAGABGATTCAG | Severe myoclonic epilepsy in infancy, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 794726730 | SCN1A | NM_001165963.1(SCN1A): c.2134C>T (p.Arg712Ter) | CCTTCCCAAAGGCHAAYGAGCAAT | Severe myoclonic epilepsy in infancy, Generalized epilepsy with febrile seizures plus, type 2, not provided |
| 794726838 | SCN1A | NM_001165963.1(SCN1A): c.1970C>T (p.Pro657Leu) | CCTTGGTTGTGGACYTTCAGTT | Severe myoclonic epilepsy in infancy |
| 786205835 | SCN1B | NM_001037.4(SCN1B):c.4 49-1G>A | CCCTGCARCCAACAGAGACATGG | not provided |
| 786205837 | SCN1B | NM_001037.4(SCN1B):c.7 3G>A (p.Asp25Asn) | GGAGGTGRACTCGGAGACCGAGG | not provided |
| 16969925 | SCN1B | NM_001037.4(SCN1B):c.2 54G>A (p.Arg85His) | TGAGCRCTTCGAGGGCCGCCTGG | Atrial fibrillation, familial, 13 |
| 794727152 | SCN2A | NM_021007.2(SCN2A):c.2 558G>A (p.Arg853Gln) | TTCCRGCTGTAAATTAACTGGG, ATTCCRGCTGTAAATTAACTGG | Early infantile epileptic encephalopathy 11, not provided |
| 121917751 | SCN2A | NM_021007.2(SCN2A):c.2 674G>A (p.Val892Ile) | CATCRTCTTCATTTTTGCTGTGG | Benign familial neonatal-infantile seizures, not provided |
| 121917753 | SCN2A | NM_021007.2(SCN2A):c.3 956G>A (p.Arg1319Gln) | GTCCCRGTTTGAAGGAATGAGGG, TGTCCCRGTTTGAAGGAATGAGG | Benign familial neonatal-infantile seizures, not provided |
| 796053197 | SCN2A | NM_021007.2(SCN2A):c.2 809C>T (p.Arg937Cys) | CCCTTCCTGATCGTGTTCYGCGTG | not provided |
| 121917749 | SCN2A | NM_001040142.1(SCN2A): c.3988C>T (p.Leu1330Phe) | CCAGGTTGTTGTAAATGCTYTTT | Benign familial neonatal-infantile seizures |
| 587777558 | SCN3B | NM_018400.3(SCN3B):c.1 7G>A (p.Arg6Lys) | CCAGGGGAAACAATYTATTGAAG | Atrial fibrillation, familial, 16 |
| 121908545 | SCN4A | NM_000334.4(SCN4A):c.4 343G>A (p.Arg1448His) | TCCRTGTGATCCGCCTGGCCGG, GCTGTTCCRTGTGATCCGCCTGG | Paramyotonia congenita of von Eulenburg |
| 121908557 | SCN4A | NM_000334.4(SCN4A):c.2 024G>A (p.Arg675Gln) | GCAGCTGCRGGTCTTTCAAGCTGG | Normokalemic periodic paralysis, potassium-sensitive |
| 80338789 | SCN4A | NM_000334.4(SCN4A):c.3 395G>A (p.Arg1132Gln) | TGCRGGCCCTGCGTCCCCTGAGG | Hypokalemic periodic paralysis 1, Hypokalemic periodic paralysis, type 2 |
| 80338784 | SCN4A | NM_000334.4(SCN4A):c.2 006G>A (p.Arg669His) | TGTGCTACRCTCCTTCCGTCTGG | Hypokalemic periodic paralysis 1, Hypokalemic periodic paralysis, type 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 527236148 | SCN4A | NM_000334.4(SCN4A):c.664C>T (p.Arg222Trp) | CAGCACCCRGAAGGTCCTCAGGG | Hypokalemic periodic paralysis, type 2 |
| 121908555 | SCN4A | NM_000334.4(SCN4A):c.3472C>T (p.Pro1158Ser) | CCCTCCTAGGCGCCATCYCCTCC, CCTCCTAGGCGCCATCYCCTCCA | Hypokalemic periodic paralysis, type 2 |
| 794728858 | SCN5A | NM_198056.2(SCN5A):c.1891-1G>A | CACTCARACCACGCCATCGGAGG | not provided |
| 794728926 | SCN5A | NM_198056.2(SCN5A):c.1122G>A (p.Trp374Ter) | CTGRGAGCGCCTCTATCAGCAGG | not provided |
| 794728933 | SCN5A | NM_198056.2(SCN5A):c.3840+5G>A | CGTGARTGTGGGCACCCGAAGGG, ACGTGARTGTGGGCACCCGAAGG | not provided |
| 199473047 | SCN5A | NM_000335.4(SCN5A):c.128G>A (p.Arg43Gln) | GAGCCRAGAGGGGCTGCCCGAGG | Congenital long QT syndrome |
| 199473048 | SCN5A | NM_198056.2(SCN5A):c.142G>A (p.Glu48Lys) | TGCCCRAGGAGGAGAGGCTCCCGG | Congenital long QT syndrome, not provided |
| 199473084 | SCN5A | NM_000335.4(SCN5A):c.865G>A (p.Gly289Ser) | CAACRGCACCAACGCTCCGTGG | Long QT syndrome, Congenital long QT syndrome |
| 199473085 | SCN5A | NM_198056.2(SCN5A):c.874G>A (p.Gly292Ser) | AACRGCTCCGTGGAGGCCGACGG | Brugada syndrome, not provided |
| 199473086 | SCN5A | NM_000335.4(SCN5A):c.880G>A (p.Val294Met) | CTCCRTGGAGGCCGACGGCTTGG | Brugada syndrome |
| 199473088 | SCN5A | NM_000335.4(SCN5A):c.898G>A (p.Val300Ile) | CGGCTTGRTCTGGGAATCCCTGG | Brugada syndrome |
| 199473101 | SCN5A | NM_198056.2(SCN5A):c.1127G>A (p.Arg376His) | CTGGGAGCRCCTCTATCAGCAGG | Brugada syndrome, not provided |
| 199473110 | SCN5A | NM_000335.4(SCN5A):c.1237G>A (p.Ala413Thr) | CGTGGTCRCAATGGCCTATGAGG | Congenital long QT syndrome |
| 199473138 | SCN5A | NM_000335.4(SCN5A):c.1960G>A (p.Glu654Lys) | GCTTCRAGGAGCCAGGAGCACGG | Congenital long QT syndrome |
| 199473159 | SCN5A | NM_000335.4(SCN5A):c.2365G>A (p.Val789Ile) | CATCRTCATCCTTAGCCTCATGG | Brugada syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473172 | SCN5A | NM_000335.4(SCN5A):c.2 678G>A (p.Arg893His) | TCCDCATCCTCTGTGGAGAGTGG | Brugada syndrome |
| 199473195 | SCN5A | NM_000335.4(SCN5A):c.3 337G>A (p.Asp1113Asn) | AGGCCRACTGGCGGCAGCAGTGG | Congenital long QT syndrome |
| 199473206 | SCN5A | NM_198056.2(SCN5A):c.3 695G>A (p.Arg1232Gln) | AGAGGAGCRGAAGACCATCAAG G | Brugada syndrome, not provided |
| 199473233 | SCN5A | NM_198056.2(SCN5A):c.4 057G>A (p.Val1353Met) | TGGGCRTGAACCTCTTTGCGGGG, ATGGGCRTGAACCTCTTTGCGGG, CATGGGCRTGAACCTCTTTGCGG | Brugada syndrome, not provided |
| 199473294 | SCN5A | NM_198056.2(SCN5A):c.5 038G>A (p.Ala1680Thr) | CTTCRCTTATGTCAAGTGGGAGG, CAACTTCRCTTATGTCAAGTGGG, CCAACTTCRCTTATGTCAAGTGG | Brugada syndrome, Sudden cardiac death, not provided |
| 199473341 | SCN5A | NM_000335.4(SCN5A):c.3 832G>A (p. Val1278Ile) | CTCATCRTAGACGTGAGTGTGG, CCTCATCRTAGACGTGAGTGTGG | Primary dilated cardiomyopathy, Dilated cardiomyopathy, not provided |
| 199473552 | SCN5A | NM_000335.4(SCN5A):c.1 03G>A (p.Gly35Ser) | CCGCRGCTCAACCACCTTGCAGG | Brugada syndrome |
| 199473572 | SCN5A | NM_000335.4(SCN5A):c.1 384G>A (p.Glu462Lys) | CTCCTTGPAGATGTCCCCTTTGG | Long QT syndrome, Congenital long QT syndrome, not provided |
| 199473582 | SCN5A | NM_000335.4(SCN5A):c.2 236G>A (p.Glu746Lys) | TTCRAGGAGATGCTGCAGGTCGG, TGAATTCRAGGAGATGCTGCAGG | Brugada syndrome |
| 199473584 | SCN5A | NM_198056.2(SCN5A):c.2 441G>A (p.Arg814Gln) | CCAGCTGCRGGTCTTCAAGCTGG | Brugada syndrome |
| 199473595 | SCN5A | NM_000335.4(SCN5A):c.3 553G>A (p.Ala1185Thr) | CACAGRCCCCAGGGAAGGTCTGG | Congenital long QT syndrome, not specified |
| 199473605 | SCN5A | NM_198056.2(SCN5A):c.4 018G>A (p.Val1340Ile) | TCCTCRTCGCCTCATCTTCTGG | Brugada syndrome, not provided |
| 199473637 | SCN5A | NM_000335.4(SCN5A):c.5 800G>A (p.Gly1934Ser) | GGGCAGCRGCCTCTCCGAAGAGG | Brugada syndrome |
| 778522112 | SCN5A | NM_198056.2(SCN5A):c.1 880C>T (p.Pro627Leu) | GGCRGGTGCTCTAGCATCACAGG | not provided |
| 137854601 | SCN5A | NM_198056.2(SCN5A):c.5 350G>A (p.Glu1784Lys) | GAGCACCRAGCCCCTGAGTGAGG | Long QT syndrome 3, Brugada syndrome 1, Sinus node disease, Congenital long QT syndrome, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 187531872 | SCN5A | NM_198056.2(SCN5A):c.98+5G>A | CCCGGGGTGGTAGGTGCCAYATA, CCGGGTGGTAGGTGCCAYATAC | Arrhythmogenic right ventricular cardiomyopathy, not specified, not provided |
| 794728877 | SCN5A | NM_198056.2(SCN5A):c.994C>T (p.Pro332Ser) | CCCTGTGGGCGCCATCYCTCC, CCTGTGGGCGCCATCYCTGTCCA | not provided |
| 199473072 | SCN5A | NM_000335.4(SCN5A):c.673C>T (p.Arg225Trp) | CCTTCCGAGTCCTCYGGGCCCTG | Congenital long QT syndrome, Cardiac conduction defect, nonspecific, not provided |
| 199473097 | SCN5A | NM_198056.2(SCN5A):c.1099C>T (p.Arg367Cys) | CCTTTCTTGCACTCTTCYGCCTG | Congenital long QT syndrome, not provided |
| 199473133 | SCN5A | NM_000335.4(SCN5A):c.1855C>T (p.Leu619Phe) | CCCCAGGAAGCCACCTCYTCCGC, CCCAGGAAGCCACCTCYTCCGCC, CCAGGAAGCCACCTCYTCCGCCC | Brugada syndrome, Long QT syndrome |
| 199473134 | SCN5A | NM_000335.4(SCN5A):c.1895C>T (p.Thr632Met) | CCTGATTGCACTCAGAYCAVGCC | Brugada syndrome |
| 199473139 | SCN5A | NM_000335.4(SCN5A):c.1981C>T (p.Arg661Trp) | CCAGGAGCACGGCAGYGGGCCCT | Brugada syndrome |
| 199473171 | SCN5A | NM_198056.2(SCN5A):c.2677C>T (p.Arg893Cys) | CCTTCCTCATCATTTCYGCATC | Brugada syndrome, not provided |
| 199473192 | SCN5A | NM_000335.4(SCN5A):c.3296C>T (p.Ala1099Val) | CCTGGAGCCAGGTGTCAGYGACT | Long QT syndrome, Congenital long QT syndrome, not provided |
| 199473194 | SCN5A | NM_000335.4(SCN5A):c.3335C>T (p.Ala1112Val) | CCAGTGCATCTCAGYCGACTGG | Brugada syndrome |
| 199473197 | SCN5A | NM_000335.4(SCN5A):c.3392C>T (p.Thr1131Ile) | CCACACCCCTGTCCATAGAYCCC, CCCCTGTCCATAGAYCCCAGAGG | Atrial fibrillation, not provided |
| 199473200 | SCN5A | NM_000335.4(SCN5A):c.3520C>T (p.Arg1174Cys) | CCATAGGCTGTGTCCGGYGCTG, CCATAGGCTGTGTCCGGYGCTGT | Congenital long QT syndrome |
| 199473225 | SCN5A | NM_198056.2(SCN5A):c.3995C>T (p.Pro1332Leu) | CCCTGTGGGCGCCATCCBTCC, CCTGTGGGCGCCATCCBTCCA | Brugada syndrome, not provided |
| 199473288 | SCN5A | NM_198056.2(SCN5A):c.4934C>T (p.Thr1645Met) | CCAAGGGGATCCGCAYGCTGCTC | Congenital long QT syndrome, not provided |
| 199473561 | SCN5A | NM_000335.4(SCN5A):c.677C>T (p.Ala226Val) | CCTTCCGAGTCCTCCGGGYCCTG, CCGAGTCCTCCGGGYCCTGAAAA | Brugada syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 199473576 | SCN5A | NM_198056.2(SCN5A):c.1705C>T (p.Arg569Trp) | CCCTGGCCCCTGCGCBGGACCAG, CCTGGCCCCTGCGCBGGACCAGT | Congenital long QT syndrome, not provided |
| 199473577 | SCN5A | NM_000335.4(SCN5A):c.1858C>T (p.Arg620Cys) | CCCAGGAAGCCACCTCCTCYGCC, CCAGAAGCCACCTCCTCYGCCC | Brugada syndrome |
| 199473580 | SCN5A | NM_000335.4(SCN5A):c.2065C>T (p.Arg689Cys) | CCACCATGCTGGAACYGTCTCGC | Congenital long QT syndrome |
| 199473603 | SCN5A | NM_000335.4(SCN5A):c.3908C>T (p.Thr1303Met) | CCCATCAAGTCACTCGCGAYGCT, CCATCAAGTCACTGCGAYGCTG | Long QT syndrome, Congenital long QT syndrome, not provided |
| 199473640 | SCN5A | NM_198056.2(SCN5A):c.6034C>T (p.Arg2012Cys) | CCCTTCTCCGACAGGACYGTG, CCTTCTCCGACAGGGACYGTGA | Congenital long QT syndrome, not provided |
| 192113333 | SCN5A | NM_198056.2(SCN5A):c.553G>A (p.Ala185Thr) | CCCGAAGGAAAGTGAACGYGTGC, CCGAAGGAAAGTGAACGYGTGCA | Congenital long QT syndrome, not provided |
| 769292594 | SCN5A | NM_198056.2(SCN5A):c.1706G>A (p.Arg569Gln) | CCCTGGGCACTGGTCYGGCGCAG, CCTGGGCACTGGTCYGGCGCAGG | not provided |
| 137854602 | SCN5A | NM_000335.4(SCN5A):c.4531C>T (p.Arg1511Trp) | CCCAGAAGCCCATCCCAYGGCC, CCCAGAAGCCCATCCCAYGGCCC, CCAGAAGCCCATCCCAYGGCCCC | Brugada syndrome 1, Primary familial hypertrophic cardiomyopathy, not provided |
| 137854604 | SCN5A | NM_000335.4(SCN5A):c.5126C>T (p.Ser1709Leu) | CCAGATCACCACGTYGGCCGGCT | Brugada syndrome 1, Ventricular fibrillation, Paroxysmal familial ventricular fibrillation, not provided |
| 587777721 | SCN8A | NM_014191.3(SCN8A):c.4850G>A (p.Arg1617Gln) | CCTATTCCRAGTCATCCGATTGG | Early infantile epileptic encephalopathy 13 |
| 587780586 | SCN8A | NM_014191.3(SCN8A):c.2549G>A (p.Arg850Gln) | TTAGCTCCRAGTCTTTCAAATTGG | Early infantile epileptic encephalopathy 13, not provided |
| 137852635 | SCNN1A | NM_001038.5(SCNN1A):c.1685C>T (p.Ser562Leu) | CCTGTGGTTCGGCTCCTYGGCTGT | Pseudohypoaldosteronism type 1 autosomal recessive |
| 137852708 | SCNN1B | NM_000336.2(SCNN1B):c.1849C>T (p.Pro617Ser) | CCCATCCCAGGCACCCGYCCCC, CCATCCCAGGCACCCCGYCCCCC | Pseudoprimary hyperaldosteronism |
| 5738 | SCNN1G | NM_001039.3(SCNN1G):c.589G>A (p.Glu197Lys) | ATCRAGTCCAAGCAAGTGGTGGG, CATCRAGTCCAAGCAAGTGGTGG, GCACATCRAGTCCAAGCAAGTGG | Bronchiectasis with or without elevated sweat chloride 3 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853342 | SCNN1G | NM_001039.3(SCNN1G):c. 1718G>A (p.Trp573Ter) | GGAGTGGTRGGCCTGGAAACAG G | Pseudoprimary hyperaldosteronism |
| 104894630 | SCO1 | NM_004589.3(SCO1):c.521 C>T (p.Pro174Leu) | CCCTGATGTCTGTCYAGAGAAC | Cytochrome-c oxidase deficiency |
| 587777220 | SCO1 | NM_004589.3(SCO1):c.394 G>A (p.Gly132Ser) | CCCCAAGTAAAGGCTTGCYGAT, CCCCAAGTAAAGGCTTGCYGATG, CCCAAGTAAAGGCTTGCYGATGT, CCAAGTAAAGGCTTGCYGATGTG | Cytochrome-c oxidase deficiency |
| 397515337 | SDCCAG8 | NM_006642.3(SDCCAG8): c.-740+356C>T | CCAACATGTGAAACCCYGTTTC | Bardet-Biedl syndrome 16 |
| 137852768 | SDHA | NM_004168.3(SDHA):c.16 64G>A (p.Gly555Glu) | CCCAGRAATGGTCTGGAACACGG | Mitochondrial complex II deficiency, Dilated cardiomyopathy 1GG |
| 9809219 | SDHA | NM_004168.3(SDHA):c.16 60C>T (p.Arg554Trp) | CCTGAAGACGTTCGACYGGGGTG | Mitochondrial complex II deficiency |
| 74315371 | SDHB | NM_003000.2(SDHB):c.30 2G>A (p.Cys101Tyr) | TCTTRTGCAATGAACATCAATGG | Pheochromocytoma |
| 786203251 | SDHB | NM_003000.2(SDHB):c.72 4C>T (p.Arg242Cys) | CCCATTCTCTATACYGCTGCC, CCATTCTCTATACYGCTGCCA | Hereditary cancer-predisposing syndrome |
| 772551056 | SDHB | NM_003000.2(SDHB):c.13 7G>A (p.Arg46Gln) | CCTTGTCTGGGTCCCATYGATAG | Hereditary cancer-predisposing syndrome, not provided |
| 587776652 | SDHC | NM_003001.3(SDHC):c.3G >A (p.Met1Ile) | AGATRGCTGCGCTGTTGCTGAGG | Paragangliomas 3 |
| 764575966 | SDHC | NM_003001.3(SDHC):c.39 7C>T (p.Arg133Ter) | CCTGRAATGGGATCYGACACTTG | Hereditary cancer-predisposing syndrome |
| 34677591 | SDHD | NM_003002.3(SDHD):c.34 G>A (p.Gly12Ser) | TGCRGTGCCCTAGGAGGCCCAGG | Pheochromocytoma, Paragangliomas 1, Hereditary cancer-predisposing syndrome, Carcinoid tumor of intestine, Cowden syndrome 3, not specified, not provided |
| 104894306 | SDHD | NM_003002.3(SDHD):c.64 C>T (p.Arg22Ter) | CCTCAGCTCTGTTGCTTYGAACT | Pheochromocytoma, Paragangliomas 1 |
| 80338844 | SDHD | NM_003002.3(SDHD):c.24 2C>T (p.Pro81Leu) | CCTGGGTCTGCTTCYGGCTGCTT | Pheochromocytoma, Hereditary Paraganglioma-Pheochromocytoma Syndromes, Paragangliomas 1, Hereditary cancer-predisposing syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918222 | SEC23B | NM_032985.4(SEC23B):c.4 0C>T (p.Arg 14Trp) | CCAGCAGAATGAAGAAYGGGAT G | Congenital dyserythropoietic anemia, type II, not provided |
| 121918226 | SEC23B | NM_032985.4(SEC23B):c.6 49C>T (p.Arg217Ter) | CCCATGCAGCAAGCAYGACCTGC, CCATCAGCAAGCAYGACCTGCA | Congenital dyserythropoietic anemia, type II, not provided |
| 727504145 | SEC23B | NM_032985.4(SEC23B):c.1 489C>T (p.Arg497Cys) | CCCAGAGACGCATYGCGTGACC | not provided |
| 786204845 | SEC24D | NM_014822.2(SEC24D):c. 613C>T (p.Gln205Ter) | CCTCCTCCTCCAAATGCCYAGTA, CCTCCTCCAAATGCCYAGTACCA | COLE-CARPENTER SYNDROME 2 |
| 730880269 | SECISBP2 | NM_024077.4(SECISBP2): c.1212+29G>A | CATGTRTGATATATAAGTGGG, ACATGGTRTGATATATAATAAGTGG | Thyroid hormone metabolism, abnormal |
| 121918341 | SEMA3E | NM_012431.2(SEMA3E):c. 2108C>T (p.Ser703Leu) | CCTGCTCAGAGTAGCATCYTGCA | CHARGE association |
| 41265017 | SEMA4A | NM_001193301.1(SEMA4 A):c.2138G>A (p.Arg713Gln) | CGGGCTCRGGGCAAGGTTCAGG, CCGGGCTCRGGGCAAGGTTCAGG | Retinitis pigmentosa 35, not specified |
| 587776597 | SEPN1 | NM_020451.2(SEPN1):c.13 85G>A (p.Sec462=) | GCTRAGGTGAGGGGCCCGGCTGG, TCCTGCTRAGGTGAGGGGCCCG | Eichsfeld type congenital muscular dystrophy |
| 55819880 | SERPINA 1 | NM_001127701.1(SERPIN A1):c.230C>T (p.Ser77Phe) | CCAATATCTTCTTCYCCCAGTG | Alpha-1-antitrypsin deficiency |
| 28929488 | SERPINA 6 | NM_001756.3(SERPINA6): c.1165G>A (p.Asp389Asn) | TGATCTTCRACCACTTCACCTGG | Corticosteroid-binding globulin deficiency |
| 72554659 | SERPINA 7 | NM_000354.5(SERPINA7): c.1051C>T (p.His351Tyr) | CCCCACACAGGCTGCCYATAAGG, CCCACACAGGCTGCCYATAAGGC, CCACACAGGCTGCCYATAAGGCT | |
| 121909546 | SERPINC 1 | NM_000488.3(SERPINC1): c.1306G>A (p.Ala436Thr) | CAAGRCCAACAGGCCTTTCCTGG | Antithrombin III deficiency |
| 121909562 | SERPINC 1 | NM_000488.3(SERPINC1): c.481C>T (p.Arg161Ter) | CCAAACTGAACTGCYGACTCTAT | Antithrombin III deficiency |
| 121909567 | SERPINC 1 | NM_000488.3(SERPINC1): c.391C>T (p.Leu131Phe) | CCTGTAATGACACCYTCCAGCAA | Antithrombin III deficiency |
| 28929469 | SERPINC 1 | NM_000488.3(SERPINC1): c.166C>T (p.Arg56Cys) | CCCATGTGCATTTACYGCTCCCC, CCATGTGCATTTACYGCTCCCG | Antithrombin III deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 6092 | SERPINE1 | NM_000602.4(SERPINE1): c.43G>A (p.Ala15Thr) | CTGRCCCTGTCTTGGTGAAGG | Plasminogen activator inhibitor type 1 deficiency |
| 193302873 | SERPINF1 | NM_002615.5(SERPINF1): c.1132C>T (p.Gln378Ter) | CCCCAGCCCAGGGCTGYAGCCT, CCCCAGCCCAGGGCTGYAGCCTG, CCCAGCCCAGGGCTGYAGCCTGC, CCAGCCCAGGGCTGYAGCCTGCC | Osteogenesis imperfecta type 12, not provided |
| 121907950 | SERPING1 | NM_000062.2(SERPING1): c.1394C>T (p.Ala465Val) | CCTCGCCATCTCTGTGGYCCGC, CCGCCATCTCTGTGGYCCGCACC | Complement component 4, partial deficiency of, due to dysfunctional c1 inhibitor |
| 28940290 | SETX | NM_015046.5(SETX):c.6638C>T (p.Pro2213Leu) | CCTAAGCAGCTCCCTCYGACAGT | Spinocerebellar ataxia autosomal recessive 1 |
| 267607044 | SETX | NM_015046.5(SETX):c.3880C>T (p.Arg1294Cys) | CCTGAAAAAGGGTCCTYGTAAGG | Spinocerebellar ataxia autosomal recessive 1 |
| 121917836 | SFTPC | NM_003018.3(SFTPC):c.196G>A (p.Glu66Lys) | ACGRAGATGGTGAGAGGTGTGG G, CACGRAGATGGTGAGAGGTGTGG | Surfactant metabolism dysfunction, pulmonary, 2 |
| 143570936 | SGCA | NM_000023.2(SGCA):c.739G>A (p. Val247Met) | CAATRTGACCCTGGTGAGGAGGG, GCAATRTGACCCTGGTGAGGAGG, GGTGCAATRTGACCCTGGTGAGG | Limb-girdle muscular dystrophy, type 2D, not provided |
| 28933693 | SGCA | NM_000023.2(SGCA):c.229C>T (p.Arg77Cys) | CCTGCCCCGTGGCTCYGCTACA | Limb-girdle muscular dystrophy, type 2D, not provided |
| 387907298 | SGCA | NM_000023.2(SGCA):c.574C>T (p.Arg192Ter) | CCCCCTTCCCATTGAGGGCYGAA, CCCTTCCCATTGAGGGCYGAAA, CCCTTCCCATTGAGGGCYGAAAA, CCTTCCCATTGAGGGCYGAAAAG | Limb-girdle muscular dystrophy, type 2D |
| 104894635 | SGSH | NM_000199.3(SGSH):c.734G>A (p.Arg245His) | TCGGCRCATGGACCAAGGTGGG, GTCGGCRCCATGGACCAAGGTGG | Mucopolysaccharidosis, MPS-III-A, not provided |
| 104894639 | SGSH | NM_000199.3(SGSH):c.1339G>A (p.Glu447Lys) | CCCCACRAGACCCAGAACCTGG | Mucopolysaccharidosis, MPS-III-A, not provided |
| 111033627 | SH2D1A | NM_002351.4(SH2D1A):c.203C>T (p.Thr68Ile) | CCTTTTATTTTCCAGAYAGCACC | Lymphoproliferative syndrome 1, X-linked |
| 367543284 | SH3PXD2B | NM_001017995.2(SH3PXD2B):c.401+1G>A | CAAAGARTAAGTTTGTTTGTGGG, CCAAAGARTAAGTTTGTTTGTGG | Frank Ter Haar syndrome, Borrone Di Rocco Crovato syndrome |
| 267607046 | SH3PXD2B | NM_001017995.2(SH3PXD2B):c.127C>T (p.Arg43Trp) | CCACCGAGGCCATTTACYGCGC, CCGAGGCCATTTACYGGCGCTAC | Frank Ter Haar syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80338922 | SH3TC2 | NM_024577.3(SH3TC2):c. 1178-1G>A | CTTACARCATCCCAGCCTGAAGG | Charcot-Marie-Tooth disease, type 4C |
| 80338923 | SH3TC2 | NM_024577.3(SH3TC2):c. 1586G>A (p.Arg529His) | GCCCRTCTCTGCTTCCTCCTGGG, TGCCCRTCTCTGCTTCCTCCTGG | Charcot-Marie-Tooth disease, type 4C |
| 80338926 | SH3TC2 | NM_024577.3(SH3TC2):c. 1972C>T (p.Arg658Cys) | CCTGCCCTTTGCCGAGYGCCTGC | Charcot-Marie-Tooth disease, type 4C |
| 80338937 | SH3TC2 | NM_024577.3(SH3TC2):c. 3601C>T (p.Gln1201Ter) | CCTCTGTCCACCATGGCTGYAGA | Charcot-Marie-Tooth disease, type 4C |
| 387906932 | SHANK3 | NM_033517.1(SHANK3):c. 3349C>T (p.Arg1117Ter) | CCCTGGCTGCCGAGAGYGAGCT, CCTGGCTGCCGAGAGYGAGCTC | Schizophrenia 15 |
| 104894043 | SHH | NM_000193.3(SHH):c.676 G>A (p.Ala226Thr) | GTGCTGRCGCGACGACCAGGG, CGTGCTGRCGGCGACGACCAGG | Holoprosencephaly 3 |
| 104894047 | SHH | NM_000193.3(SHH):c.869 G>A (p.Gly290Asp) | CGGRCTCGGGGCCGCCTTCCGGG, TCGGRCTCGGGGCCGCCTTCCGG | Holoprosencephaly 3, Schizencephaly, not specified |
| 587778805 | SHH | NM_000193.3(SHH):c.664 G>A (p.Asp222Asn) | CGGGRACCGCGTGCTGGCGCGG, CCCCGGRACCGCGTGCTGGCGG | Holoprosencephaly 3 |
| 137853341 | SHH | NM_000193.3(SHH):c.1147 G>A (p.Ala383Thr) | CCGCCTGRCGCACGCGCTCTGG | Holoprosencephaly 3 |
| 587778803 | SHH | NM_000193.3(SHH):c.625 C>T (p.Gln209Ter) | CCACGGTGCACCTGAGYAGGGC | Holoprosencephaly 3 |
| 137852556 | SHOX | NM_000451.3(SHOX):c.51 7C>T (p.Arg173Cys) | CCGGAGAGCCAAGTGCYGCAAA C | Leri Weill dyschondrosteosis |
| 121912616 | SI | NM_001041.3(SI):c.3218G >A (p.Gly1073Asp) | CTTTTGRCATCCAGATTCGACGG | Sucrase-isomaltase deficiency |
| 786205162 | SIK1 | NM_173354.3(SIK1):c.189 7C>T (p.Gln63Ter) | CCCCTTCCACGCCCCTGCAYAGA, CCCTTCCACGCCCCTGCAYAGAG, CCTTCCACGCCCCTGCAYAGAGC | EPILEPTIC ENCEPHALOPATHY, EARLY INFANTILE, 30 |
| 119456965 | SIL1 | NM_001037633.1(SIL1):c.3 31C>T (p.Arg111Ter) | CCAATATGAGGACAAGTTCYGAA | Marinesco-Sj\xc3\xb6gren syndrome |
| 119456966 | SIL1 | NM_001037633.1(SIL1):c.1 312C>T (p.Gln438Ter) | CCAGCCTGAGCTGYAGGATGGT | Marinesco-Sj\xc3\xb6gren syndrome, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 80356459 | SIX1 | NM_005982.3(SIX1):c.328 C>T (p.Arg110Trp) | CCGTGGGCAAATATYGGGTGCGC | Branchiootic syndrome 3 |
| 121917881 | SIX3 | NM_005413.3(SIX3):c.206 G>A (p.Gly69Asp) | CGGCGRCTCCAGGGCCCCCCCGG | Holoprosencephaly 2 |
| 80356462 | SIX5 | NM_175875.4(SIX5):c.886 G>A (p.Ala296Thr) | TCCRCCGAGCCGCTGCCCAGGG, GTCCRCCGAGGCCGCTGCCCAGG | Branchiootorenal syndrome 2 |
| 121918366 | SLC11A2 | NM_001174125.1(SLC11A2):c.1333C>T (p.Arg445Cys) | CCCGAGTGGTTCTGACTYGCTCT, CCGAGTGGTTCTGACTYGCTCTA | Hypochromic microcytic anemia with iron overload |
| 267607051 | SLC12A3 | NM_000339.2(SLC12A3):c.2612G>A (p.Arg871His) | AAGATCCRTGTGTTCGTAGGCGG | Familial hypokalemia-hypomagnesemia |
| 28936388 | SLC12A3 | NM_000339.2(SLC12A3):c.625C>T (p.Arg209Trp) | CCTACTTCCTCATCTCCYGGAGT | Familial hypokalemia-hypomagnesemia |
| 371443644 | SLC12A3 | NM_000339.2(SLC12A3):c.179C>T (p.Thr60Met) | CCTTTGGCTACAACAYGATCGAT | Familial hypokalemia-hypomagnesemia |
| 606231229 | SLC12A6 | NM_005135.2(SLC12A6):c.3247C>T (p.Arg1083Ter) | CCGAGGGACTAGAGYGAGTCCTA | Andermann syndrome |
| 121908428 | SLC12A6 | NM_133647.1(SLC12A6):c.2023C>T (p.Arg675Ter) | CCCAACTGGAGACCCYGATTCCG, CCAACTGGAGACCCYGATTCCGC | Andermann syndrome |
| 587777577 | SLC13A5 | NM_177550.4(SLC13A5):c.680C>T (p.Thr227Met) | TCCCRTCCCGGTCAGGGTGGCGG, GGGTCCCRTCCCGGTCAGGGTGG | Epileptic encephalopathy, early infantile, 25 |
| 121909386 | SLC16A12 | NM_213606.3(SLC16A12):c.733C>T (p.Gln245Ter) | CCATGTGTGTAGAGACTYAGAAAG | Cataract, juvenile, with microcornea and glucosuria |
| 587784382 | SLC16A2 | NM_006517.4(SLC16A2):c.916C>T (p.Gln306Ter) | CCAGCGCTTTCTGGCTYAGCTCA | Allan-Herndon-Dudley syndrome |
| 587784386 | SLC16A2 | NM_006517.4(SLC16A2):c.277C>T (p.Gln93Ter) | CCGCGCGGCGCTTCYAGCCTCCC | Allan-Herndon-Dudley syndrome |
| 80338794 | SLC17A5 | NM_012434.4(SLC17A5):c.115C>T (p.Arg39Cys) | CCAGTGTGTGCTCTGCTYGTTA | Salla disease |
| 606231251 | SLC17A9 | NM_022082.3(SLC17A9):c.932G>A (p.Arg311Gln) | GTGCRGAAGCTCATGCAGGTAGG, CACGGTGCRGAAGCTCATGCAGG | Porokeratosis 8, disseminated superficial actinic type |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 548728088 | SLC17A9 | NM_022082.3(SLC17A9):c.25C>T (p.Arg9Cys) | CCACCCCAGACGAGGCCYGCAG, CCCCAGACGAGGCCYGCAGGG A, CCCCAGACGAGGCCYGCAGGGA C | Porokeratosis 8, disseminated superficial actinic type |
| 121908540 | SLC19A2 | NM_006996.2(SLC19A2):c.152C>T (p.Pro51Leu) | CCTCAGGGCCGTCCGAGCYCTTCC | Megaloblastic anemia, thiamine-responsive, with diabetes mellitus and sensorineural deafness |
| 587777696 | SLC1A1 | NM_004170.5(SLC1A1):c.1333C>T (p.Arg445Trp) | CCCGTCTCTCCCCAGGGACYGGT, CCGTCTCTCCCCAGGGACYGGTT | Dicarboxylic aminoaciduria |
| 121907892 | SLC22A12 | NM_144585.3(SLC22A12):c.774G>A (p.Trp258Ter) | CTGRACACTGCTGCAGCTGGTGG, GGACTGRACACTGCTGCAGCTGG | Familial renal hypouricemia |
| 121907896 | SLC22A12 | NM_144585.3(SLC22A12):c.269G>A (p.Arg90His) | GCCRCTTCCGCCAGCCACAGTGG | Familial renal hypouricemia |
| 78838117 | SLC22A18 | NM_002555.5(SLC22A18):c.257G>A (p.Arg86His) | AGACCAGCRCGGGGCGCGGGCG G | |
| 121909071 | SLC22A18 | NM_183233.2(SLC22A18):c.698C>T (p.Ser233Phe) | CCTGAAGGCCATCGCCTYCCTGC | Lung cancer |
| 121908891 | SLC22A5 | NM_003060.3(SLC22A5):c.1196G>A (p.Arg399Gln) | TTTGCCCRGCGCTATTCCATGG | Renal carnitine transport defect |
| 386134210 | SLC22A5 | NM_003060.3(SLC22A5):c.845G>A (p.Arg282Gln) | CCCCRATGGCTCATCTCTCAGGG, CCCCRATGGCTCATCTCTCAGG | Renal carnitine transport defect |
| 386134199 | SLC22A5 | NM_003060.3(SLC22A5):c.641C>T (p.Ala214Val) | CCAACTATGTGGCAGYATTTGTC | Renal carnitine transport defect, not provided |
| 368647424 | SLC25A1 | NM_005984.4(SLC25A1):c.389G>A (p.Gly130Asp) | CCTCGGCCACGCCAGCGYCCAGG | Combined d-2- and 1-2-hydroxyglutaric aciduria |
| 121908532 | SLC25A13 | NM_014251.2(SLC25A13):c.1763G>A (p.Arg588Gln) | TTTCRATCCTCACCCCAGTTTGG | Citrullinemia type II |
| 80338715 | SLC25A13 | NM_014251.2(SLC25A13):c.15G>A (p.Lys5=) | CCAARGTAACCGCGGGCCCGAGG | Neonatal intrahepatic cholestasis caused by citrin deficiency |
| 202247804 | SLC25A15 | NM_014252.3(SLC25A15):c.569G>A (p.Gly190Asp) | TCGGTGRCTATGAACTGAGCCGG | Hyperornithinemia-hyperammonemia-homocitrullinuria syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 202247805 | SLC25A15 | NM_014252.3(SLC25A15): c.658G>A (p.Gly220Arg) | GAGTTGGTRGGATTTGCCTCTGG | Hyperornithinemia-hyperammonemia-homocitrullinuria syndrome |
| 104894431 | SLC25A15 | NM_014252.3(SLC25A15): c.824G>A (p.Arg275Gln) | ATTCRAGCATTCCCTGCCAATGG | Hyperornithinemia-hyperammonemia-homocitrullinuria syndrome |
| 202247809 | SLC25A15 | NM_014252.3(SLC25A15): c.847C>T (p.Leu283Phe) | CCCTGCCAATGGAGCAYTCTTTT, CCTGCCAATGGAGCAYTCTTTTT | Hyperornithinemia-hyperammonemia-homocitrullinuria syndrome |
| 151340616 | SLC25A20 | NM_000387.5(SLC25A20): c.496C>T (p.Arg166Ter) | CCAGGAGTTTGGGATCYGAGGCA | Carnitine acylcarnitine translocase deficiency |
| 104894375 | SLC25A3 | NM_005888.3(SLC25A3):c. 215G>A (p.Gly72Glu) | CTTGGAGRAATTATTAGCTGTGG | Mitochondrial phosphate carrier deficiency |
| 398122942 | SLC25A4 | NM_001151.3(SLC25A4):c. 111+1G>A | TGCTGCAGRTGAGGACCGCGCGG | Mitochondrial DNA depletion syndrome 12 (cardiomyopathic type) |
| 111033309 | SLC26A4 | NM_000441.1(SLC26A4):c. 2015G>A (p.Gly672Glu) | TGTTGRAGTGAGATCACTGCGGG, TTGTTGRAGTGAGATCACTGCGG | Pendred syndrome, Enlarged vestibular aqueduct syndrome |
| 111033220 | SLC26A4 | NM_000441.1(SLC26A4):c. 1229C>T (p.Thr410Met) | CCACTGCTCTTTCCCGACAYGGCC | Pendred syndrome, Enlarged vestibular aqueduct syndrome |
| 142724470 | SLC26A8 | NM_052961.3(SLC26A8):c. 2434G>A (p.Glu812Lys) | CCCGTATCACTGTCTYGGATTCA, CCGTATCACTGTCTYGGATTCAT | Spermatogenic failure 3 |
| 137853132 | SLC27A4 | NM_005094.3(SLC27A4):c. 274G>A (p.Ala92Thr) | AAGACGRCCCTGATCTTCGAGGG, CAAGACGRCCCTGATCTTCGAGG | Ichthyosis prematurity syndrome |
| 121912583 | SLC29A3 | NM_018344.5(SLC29A3):c. 1279G>A (p.Gly427Ser) | CAACRGCTACCTCAGCACCCTGG | Histiocytosis-lymphadenopathy plus syndrome |
| 387907066 | SLC29A3 | NM_018344.5(SLC29A3):c. 1088G>A (p.Arg363Gln) | GTGGCCRGCAGCTCACCGCCTGG | Histiocytosis-lymphadenopathy plus syndrome |
| 587780462 | SLC29A3 | NM_018344.5(SLC29A3):c. 1228C>T (p.Gln410Ter) | CCTGAAGACTGTGTCTTCYAGT | Histiocytosis-lymphadenopathy plus syndrome |
| 80359814 | SLC2A1 | NM_006516.2(SLC2A1):c. 272G>A (p.Gly91Asp) | CTTTGRCCCGGTAAGTAGGAGAGG | Glucose transporter type 1 deficiency syndrome |
| 80359841 | SLC2A1 | NM_006516.2(SLC2A1):c. 18+1G>A | AAGRTGAGTCGCGCGCCCCGCGG, CAAGRTGAGTCGCGCGCCCCGCG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909739 | SLC2A1 | NM_006516.2(SLC2A1):c.940G>A (p.Gly314Ser) | TGGCTCCRGTATCGTCAACACGG | GLUT1 deficiency syndrome 2, Glucose transporter type 1 deficiency syndrome, Epilepsy, idiopathic generalized, susceptibility to, 12, not provided |
| 796053248 | SLC2A1 | NM_006516.2(SLC2A1):c.667C>T (p.Arg223Trp) | CCGCAACGAGGAGAACYGGGCCA | not provided |
| 796053253 | SLC2A1 | NM_006516.2(SLC2A1):c.971C>T (p.Ser324Leu) | CCTTCACTGTCGTGYGGTGAGT | not provided |
| 387907313 | SLC2A1 | NM_006516.2(SLC2A1):c.694C>T (p.Arg232Cys) | CCCAGTGCTAAAGAAGCTGYGCG, CCAGTGCTAAAGAAGCTGYGCGG | Epilepsy, idiopathic generalized, susceptibility to, 12, not provided |
| 121909743 | SLC2A2 | NM_000340.1(SLC2A2):c.901C>T (p.Arg301Ter) | CCAATTCCAGCTACYGACAGCCT | Fanconi-Bickel syndrome |
| 281860290 | SLC30A10 | NM_018713.2(SLC30A10):c.922C>T (p.Gln308Ter) | CCGCTGCCATTCTGCTAYAGATG | Hypermanganesemia with dystonia, polycythemia and cirrhosis |
| 121918237 | SLC34A3 | NM_001177317.1(SLC34A3):c.586G>A (p.Gly196Arg) | CGGTGCACRGGATCTTCAACTGG | Autosomal recessive hypophosphatemic bone disease |
| 587777436 | SLC35A2 | NM_001042498.2(SLC35A2):c.638C>T (p.Ser213Phe) | GAAGCCGRAGGAGGAGACAGGAGG | CONGENITAL DISORDER OF GLYCOSYLATION, TYPE IIm |
| 587776962 | SLC35A2 | NM_001042498.2(SLC35A2):c.3G>A (p.MetIle) | CCAGCCCCAACCGGCTGCYATGTT | CONGENITAL DISORDER OF GLYCOSYLATION, TYPE IIm |
| 28939087 | SLC35C1 | NM_018389.4(SLC35C1):c.439C>T (p.Arg147Cys) | CCTTCTACAATGTGGGCYGCTCA | Congenital disorder of glycosylation type 2C |
| 137853111 | SLC35D1 | NM_015139.2(SLC35D1):c.932G>A (p.Trp311Ter) | TTCACGTRGACAAACTTCATTGG | Schneckenbecken dysplasia |
| 80356492 | SLC37A4 | NM_001164277.1(SLC37A4):c.1099G>A (p.Ala367Thr) | CCACRCCATTGTGGGACTCATGG | Glucose-6-phosphate transport defect, not provided |
| 121908980 | SLC37A4 | NM_001164277.1(SLC37A4):c.1016G>A (p.Gly339Asp) | GTATTTGRTTTCTCCTCGTATGG | Glucose-6-phosphate transport defect, not provided |
| 121908979 | SLC37A4 | NM_001164277.1(SLC37A4):c.1243C>T (p.Arg415Ter) | CCTTCTTCCTCCTAYGAACACATC | Glucose-6-phosphate transport defect |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587777256 | SLC38A8 | NM_001080442.2(SLC38A8):c.1234G>A (p.Gly412Arg) | CCAGCACAGAGACCACTCYCCAG | |
| 121434363 | SLC39A13 | NM_001128225.2(SLC39A13):c.221G>A (p.Gly74Asp) | TCCTGGRTTCCCTCATGGTGGGG, CTCCTGGRTTCCCTCATGGTGGG, CCTCCTGGRTTCCCTCATGGTGG | Spondylocheirodysplasia, Ehlers-Danlos syndrome-like |
| 121434288 | SLC39A4 | NM_130849.3(SLC39A4):c.1576G>A (p.Gly526Arg) | GACCRGGCTGGCCACCTCGCTGG | Hereditary acrodermatitis enteropathica |
| 121434292 | SLC39A4 | NM_130849.3(SLC39A4):c.283C>T (p.Arg95Cys) | CCAGGTACGTCGCCYGCCTCAGT | Hereditary acrodermatitis enteropathica |
| 121912621 | SLC45A2 | NM_016180.4(SLC45A2):c.469G>A (p.Asp157Asn) | TTGCTGCCRACTTCATTGATGGG | Oculocutaneous albinism type 4 |
| 730880270 | SLC45A2 | NM_016180.4(SLC45A2):c.563-1G>A | CCARGTTTTGGAGTGCCCTGGG, TCCARGTTTTGGAGTGCCCTGG | Oculocutaneous albinism type 4 |
| 794727511 | SLC45A2 | NM_016180.4(SLC45A2):c.856C>T (p.Gln286Ter) | CCAGAGCTGGCAATGYAGGGAG C | Oculocutaneous albinism type 4 |
| 121912741 | SLC4A1 | NM_000342.3(SLC4A1):c.2312G>A (p.Gly771Asp) | CACAGRCCTGTCCATCCTCATGG | Spherocytosis type 4 |
| 121912755 | SLC4A1 | NM_000342.3(SLC4A1):c.2279G>A (p.Arg760Gln) | GCAGCRGATCAGTGGACTCCTGG | Spherocytosis type 4 |
| 28929480 | SLC4A1 | NM_000342.3(SLC4A1):c.268G>A (p.Glu90Lys) | CTGGGGRAGAATGGGGCCTGGG G, CCTGGGGRAGAATGGGGCCTGGG, ACCTGGGGRAGAATGGGGCCTGG | Spherocytosis type 4 |
| 28931584 | SLC4A1 | NM_000342.3(SLC4A1):c.1462G>A (p.Val488Met) | ATCRTGGGCCGCGTGTGGATCGG, AGTACATCRTGGGCCGCGTGTGG | Renal tubular acidosis, distal, with hemolytic anemia, Spherocytosis type 4 |
| 387906565 | SLC4A1 | NM_000342.3(SLC4A1):c.-62G>A | CCCRCGGTGCGGGTTATGCTGGG, ACCCRCGGTGCGGGTTATGCTGG | Spherocytosis type 4 |
| 121912742 | SLC4A1 | NM_000342.3(SLC4A1):c.988C>T (p.Gln330Ter) | CCGATGCCCCTCCGAGYAGGCA | Spherocytosis type 4 |
| 121912758 | SLC4A1 | NM_000342.3(SLC4A1):c.1936C>T (p.Arg646Trp) | CCAACTCCTCAGCCYGGGGCTGG | |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912759 | SLC4A1 | NM_000342.3(SLC4A1):c.2603C>T (p.Pro868Leu) | CCTCATCCTCACTGTGCYGCTGC | |
| 28931585 | SLC4A1 | NM_000342.3(SLC4A1):c.2608C>T (p.Arg870Trp) | CCTCACTGTGCCGCTGYGGCGCG | Spherocytosis type 4 |
| 121909387 | SLC4A11 | NM_001174089.1(SLC4A11):c.2216G>A (p.Arg739Gln) | GAGACGCRGCTGACCTCGCTGGG, GGAGACGCRGCTGACCTCGCTGG | Corneal endothelial dystrophy type 2 |
| 121909392 | SLC4A11 | NM_001174089.1(SLC4A11):c.2558G>A (p.Arg853His) | CCCATCCRGTACAGGCGGGTGGG, CCCCATCCRGTACAGGCGGGTGG | Corneal endothelial dystrophy type 2 |
| 267607064 | SLC4A11 | NM_001174089.1(SLC4A11):c.2078G>A (p.Gly693Glu) | ACACAGRGCTGTCTCTGTTTGGG, AACACAGRGCTGTCTCTGTTTGG | Corneal dystrophy, Fuchs endothelial, 4 |
| 267607065 | SLC4A11 | NM_001174089.1(SLC4A11):c.1147G>A (p.Glu383Lys) | CAATGACRAGAACACAGACGGG, TCAATGACRAGAACACAGACGG | Corneal dystrophy, Fuchs endothelial, 4 |
| 121909390 | SLC4A11 | NM_001174089.1(SLC4A11):c.1765C>T (p.Arg589Ter) | CCTGCACCCCTGCCGTGYGAGAGA | Corneal endothelial dystrophy type 2 |
| 121909391 | SLC4A11 | NM_001174089.1(SLC4A11):c.2557C>T (p.Arg853Cys) | CCATGATCCCCATCYGGTACAGG | Corneal endothelial dystrophy type 2 |
| 121908857 | SLC4A4 | NM_001098484.2(SLC4A4):c.1661G>A (p.Arg554His) | TTCRCCTTTGGATTGGCYCTGTGG | Renal tubular acidosis, proximal, with ocular abnormalities and mental retardation |
| 375088539 | SLC52A2 | NM_001253815.1(SLC52A2):c.808C>T (p.Gln270Ter) | CCAGACCCTAAGGCCTATYAGCT | Brown-Vialetto-Van Laere syndrome 2 |
| 267606684 | SLC52A3 | NM_033409.3(SLC52A3):c.394C>T (p.Arg132Trp) | CCTGCCGTTCATGAGAGCYGGCTGC | Brown-Vialetto-Van laere syndrome |
| 121918621 | SLC5A2 | NM_003041.3(SLC5A2):c.1320G>A (p.Trp440Ter) | CTGRCTTCCCGTGGTGCAGGCGG, GGCCTGRCTTCCCGTGGTGCAGG | Familial renal glucosuria |
| 121434347 | SLC6A19 | NM_001003841.2(SLC6A19):c.718C>T (p.Arg240Ter) | CCTGACCATCTTCCTCATCYGAG, CCATCTTCCTCATCYGAGGCCTG | Neutral 1 amino acid transport defect |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 17279437 | SLC6A20 | NM_020208.3(SLC6A20):c. 596C>T (p.Thr199Met) | GCCRTGAAATACACCACCTGCGG | Hyperglycinuria |
| 431905514 | SLC6A3 | NM_001044.4(SLC6A3):c. 1031+1G>A | CTACAGRTGAGCCCCTAGCAGGG, GCTACAGRTGAGCCCCTAGCAGG | Infantile Parkinsonism-dystonia |
| 431905516 | SLC6A3 | NM_001044.4(SLC6A3):c. 1561C>T (p.Arg521Trp) | CCCAGCCTGTACTGGYGGCTGTG, CCAGCCTGTACTGGYGGCTGTGC | Infantile Parkinsonism-dystonia |
| 122453113 | SLC6A8 | NM_005629.3(SLC6A8):c. 1540C>T (p.Arg514Ter) | CCTGTATGATCGGGTACYGACCT | Creatine deficiency, X-linked |
| 121908482 | SLC7A9 | NM_014270.4(SLC7A9):c. 583G>A (p.Gly195Arg) | CATCAGCRGGCTGGTGCTCCTGG | Cystinuria |
| 121908483 | SLC7A9 | NM_014270.4(SLC7A9):c. 775G>A (p.Gly259Arg) | CATCRGGATCCCCCTGGTGACGG | Cystinuria |
| 121908486 | SLC7A9 | NM_014270.4(SLC7A9):c. 782C>T (p.Pro261Leu) | CCATTATCATCGGGATCCYCCTG | Cystinuria |
| 786204831 | SLC9A1 | NM_003047.4(SLC9A1):c. 913G>A (p.Gly305Arg) | GGGCRGGTGCTTGTGGGCGTGG | LICHTENSTEIN-KNORR SYNDROME |
| 119486097 | SLC9A3R1 | NM_004252.4(SLC9A3R1) :c.673G>A (p.Glu225Lys) | GGACRAGACCAAGCTGCTGGTGG, CGGGACRAGACCAAGCTGCTGG | Nephrolithiasis/osteoporosis, hypophosphatemic, 2 |
| 796053283 | SLC9A6 | NM_006359.2(SLC9A6):c. 1631+1G>A | TCATAARTATCCTTAATTGAGGG, ATCATAARTATCCTTAATTGAGG | not provided |
| 398124224 | SLC9A6 | NM_001042537.1(SLC9A6):c.1072C>T (p.Gln358Ter) | CCAAATTACGGAGTTCYAGTTG | not provided |
| 387906806 | SLCO2A1 | NM_005630.2(SLCO2A1): c.764G>A (p.Gly255Glu) | TGGATTGRAGCCTGGTGGCTAGG | Primary hypertrophic osteoarthropathy, autosomal recessive 2 |
| 587777071 | SLITRK6 | NM_032229.2(SLITRK6):c. 541C>T (p.Arg181Ter) | ACAAATCRGAAGATGTTTGGAGG | Deafness, cochlear, with myopia and intellectual impairment |
| 121908317 | SLURP1 | NM_020427.2(SLURP1):c. 286C>T (p.Arg96Ter) | CCTGATCTTCTGCTGCTTCYGAG | Acroerythrokeratoderma |
| 587776602 | SLURP1 | NM_020427.2(SLURP1):c. 178+1G>A | CCGTGGGGCCTGGCCTCAYCTGC | Acroerythrokeratoderma |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387906852 | SMAD3 | NM_005902.3(SMAD3):c.836G>A (p.Arg279Lys) | TGTCAACARGAATGCAGCAGTGG | Loeys-Dietz syndrome 3 |
| 387906853 | SMAD3 | NM_005902.3(SMAD3):c.715G>A (p.Glu239Lys) | TACRAGCTGAACCAGCGCGTCGG | Loeys-Dietz syndrome 3, not provided |
| 377767342 | SMAD4 | NM_005359.5(SMAD4):c.988G>A (p.Glu330Lys) | TTTRAAATGATGTTCAGGTAGG, TTACTTTRAAATGGATGTTCAGG | |
| 121912581 | SMAD4 | NM_005359.5(SMAD4):c.1054G>A (p.Gly352Arg) | GATRGATACGTGGACCCTTCTGG | Juvenile polyposis/hereditary hemorrhagic telangiectasia syndrome, not provided |
| 377767345 | SMAD4 | NM_005359.5(SMAD4):c.1055G>A (p.Gly352Glu) | GATGRATACGTGGACCCTTCTGG | Juvenile polyposis/hereditary hemorrhagic telangiectasia syndrome |
| 377767356 | SMAD4 | NM_005359.5(SMAD4):c.1168G>A (p.Glu390Lys) | CAGTTGRAATGTAAAGGTGAAGG | Juvenile polyposis syndrome |
| 377767326 | SMAD4 | NM_005359.5(SMAD4):c.403C>T (p.Arg135Ter) | CCATATCACTACGAAYGAGTTGT | Juvenile polyposis syndrome |
| 387907194 | SMARCA2 | NM_003070.4(SMARCA2):c.3395G>A (p.Gly1132Asp) | TGGCCTGGRCTTAAATCTTCAGG | Nicolaides-Baraitser syndrome |
| 281875188 | SMARCA2 | NM_003070.4(SMARCA2):c.2648C>T (p.Pro883Leu) | CCTCTTGACTGGGACCCYGCTGC | Nicolaides-Baraitser syndrome, not provided |
| 587777460 | SMARCA4 | NM_003072.3(SMARCA4):c.3533G>A (p.Trp1178Ter) | CAGCGACTRGAAATCCTCACCAGG | Rhabdoid tumor predisposition syndrome 2 |
| 587777461 | SMARCA4 | NM_001128845.1(SMARCA4):c.4071+1G>A | GCTCAAGRTACATGCTGGAGAGG | Rhabdoid tumor predisposition syndrome 2 |
| 587777462 | SMARCA4 | NM_001128849.1(SMARCA4):c.643C>T (p.Gln215Ter) | CCGATGCCCGGGATGCAGYAGCA | Rhabdoid tumor predisposition syndrome 2 |
| 267607070 | SMARCA4 | NM_001128844.1(SMARCA4):c.3565C>T (p.Arg1189Ter) | CCTGCAAGCGCAGGACYGAGCCC | Rhabdoid tumor predisposition syndrome 2 |
| 387906812 | SMARCB1 | NM_003073.3(SMARCB1):c.1130G>A (p.Arg377His) | GATGAGGCRTCTTGCCAACACGG | Mental retardation, autosomal dominant 15 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121434496 | SMARCB1 | NM_003073.3(SMARCB1): c.544C>T (p.Gln182Ter) | CCATGAGAACGCATCTYAGCCCG | |
| 122454123 | SMC1A | NM_006306.3(SMC1A):c.1 487G>A (p.Arg496His) | GAGCAGCRCCAGCAGCAGCGAAAG G | Congenital muscular hypertrophy-cerebral syndrome |
| 587784409 | SMC1A | NM_006306.3(SMC1A):c.2 131C>T (p.Arg711Trp) | CCCATGGACTGCAGATGYGGCTC, CCATGGACTGCAGATGYGGCTCA | Congenital muscular hypertrophy-cerebral syndrome |
| 727503776 | SMC1A | NM_006306.3(SMC1A):c.1 21C>T (p.Leu41Phe) | CCCTTAGGTAAGTCAAATYTCAT, CCTTAGGTAAGTCAAATYTCATG | Wiedemann-Steiner syndrome |
| 104893930 | SMN1 | NM_000344.3(SMN1):c.88 G>A (p.Asp30Asn) | GAGCGATRATTCTGACATTTGGG, AGAGCGATRATTCTGACATTTGG | Spinal muscular atrophy, type II |
| 120074119 | SMPD1 | NM_000543.4(SMPD1):c.1 735G>A (p.Gly579Ser) | CCATAAGRGCCACCCACCCTCGG | Niemann-Pick disease, type A |
| 397515550 | SMS | NM_004595.4(SMS):c.200 G>A (p.Gly67Glu) | CCCACACATGRATTGGTGTTGCTGG | Snyder Robinson syndrome |
| 104893875 | SNCA | NM_000345.3(SNCA):c.13 6G>A (p.Glu46Lys) | ACCAAGRAGGGAGTGGTGCATG G | Lewy body dementia |
| 104893936 | SNCB | NM_001001502.1(SNCB):c. 208G>A (p. Val70Met) | GAGCTRTGTTCTCTGGGGCAGGG, GGAGCTRTGTTCTCTGGGGCAGG | Lewy body dementia |
| 527236113 | SNRNP200 | NM_014014.4(SNRNP200) :c.2042G>A (p.Arg681His) | TAGCTTCCRTCCAGTGCCTCTGG | Retinitis pigmentosa |
| 267607078 | SOBP | NM_018013.3(SOBP):c.198 1C>T (p.Arg661Ter) | CCTGACCGTGGGCCACYGAGCCC | Mental retardation, anterior maxillary protrusion, and strabismus |
| 121912444 | SOD1 | NM_000454.4(SOD1):c.13 G>A (p.Ala5Thr) | AAGRCCGTGCGTCTGAAGGG, GAAGRCCGTGCGTCTGAAGG | Amyotrophic lateral sclerosis type 1 |
| 121912447 | SOD1 | NM_000454.4(SOD1):c.436 G>A (p.Ala146Thr) | GTTTGRCTTGTGGTGTAATTGGG, CGTTTGRCTTGTGGTGTAATTGG | Amyotrophic lateral sclerosis type 1 |
| 121912450 | SOD1 | NM_000454.4(SOD1):c.64 G>A (p.Glu22Lys) | TTCRAGCAGAGGCAAGGCTGG, CAATTCRAGCAGAAGGCAAGGG, TCAATTCRAGCAGAGGCAAGG | Amyotrophic lateral sclerosis type 1 |
| 397517147 | SOS1 | NM_005633.3(SOS1):c.129 7G>A (p.Glu433Lys) | GGTTGGRAGGGAAAAGACATTG G | Noonan syndrome 4, Rasopathy, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397517159 | SOS1 | NM_005633.3(SOS1):c.2536G>A (p.Glu846Lys) | TTTARAGAAAGAGTAGCTGTGG | Noonan syndrome 4, Rasopathy |
| 727504295 | SOS1 | NM_005633.3(SOS1):c.1322G>A (p.Cys441Tyr) | GTGTTRTAATGAATTTATAATGG | Noonan syndrome 4, Rasopathy |
| 104894644 | SOST | NM_025237.2(SOST):c.372G>A (p.Trp124Ter) | GCAAGTGRTGGCGACCTAGTGGG, GGCAAGTGRTGGCGACCTAGTGG | Sclerosteosis |
| 387907169 | SOST | NM_025237.2(SOST):c.61G>A (p.Val21Met) | GTGTARTGGAGGGCCAGGGGTGG, TCCGTGTARTGGAGGGCCAGGGG | Craniodiaphyseal dysplasia, autosomal dominant |
| 104894645 | SOST | NM_025237.2(SOST):c.376C>T (p.Arg126Ter) | CCGCGGCAAGTGGTGGYGACCTA | Sclerosteosis |
| 387906320 | SOST | NM_025237.2(SOST):c.70C>T (p.Gln24Ter) | CCGTGTAGTGGAGGGCYAGGGGT | Sclerosteosis |
| 121908510 | SPAST | NM_014946.3(SPAST):c.1343G>A (p.Cys448Tyr) | TTTGTRTGAAAGAAGAGAAGGGG, TTTTGTRTGAAAGAAGAGAAGGG, CTTTTGTRTGAAAGAAGAGAAGG | Spastic paraplegia 4, autosomal dominant |
| 149688478 | SPATA5 | NM_145207.2(SPATA5):c.1714+1G>A | CAGRTGAGTGTGGTTTGCTATGG | not provided |
| 796051895 | SPATA5 | NM_145207.2(SPATA5):c.298G>A (p.Ala100Thr) | TATACARCCTGGCCTATGGCAGG | not provided, EPILEPSY, HEARING LOSS, AND MENTAL RETARDATION SYNDROME |
| 200793464 | SPG11 | NM_025137.3(SPG11):c.5974C>T (p.Arg1992Ter) | GTCRACAGTAGTTCTTCCCATGG | Spastic paraplegia 11, autosomal recessive, Amyotrophic lateral sclerosis type 5 |
| 312262785 | SPG11 | NM_025137.3(SPG11):c.6856C>T (p.Arg2286Ter) | CCTCAGGACTCCTGTGTGYGACA | Spastic paraplegia 11, autosomal recessive |
| 267607084 | SPG11 | NM_025137.3(SPG11):c.118C>T (p.Gln40Ter) | CCCCCCGAGGCGATGGGGYAG, CCCGCCGAGGCGATGGGGYAGCT, CCGCCGAGGCGATGGGGYAGCTC, CCGAGGCGATGGGGYAGCTCGG C | Spastic paraplegia 11, autosomal recessive, Amyotrophic lateral sclerosis type 5 |
| 606231154 | SPINT2 | NM_021102.3(SPINT2):c.593-1G>A | CCTCARTGTGGTTCTGGCGGGG, TCCTCARTGTGGTTCTGGCGGG, GTCCTCARTGTGGTTCTGGCGG | Diarrhea 3, secretory sodium, congenital, syndromic |
| 104893666 | SPR | NM_003124.4(SPR):c.488C>T (p.Pro163Leu) | CCCTCTGTGCCCTGCAACYTTTC, CCTCTGTGCCCTGCAACYTTTCA | Sepiapterin reductase deficiency |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121917746 | SPR | NM_003124.4(SPR):c.355C>T (p.Gln119Ter) | CCTGAGTGACTCCACTYAAGTGA | Sepiapterin reductase deficiency |
| 769987150 | SPTBN2 | NM_006946.2(SPTBN2):c.1915G>T (p.Glu639Ter) | CCAGAGCCGCGTGATTYCTCCA | Multiple congenital anomalies |
| 267607090 | SPTLC2 | NM_004863.3(SPTLC2):c.1075G>A (p.Val359Met) | CGGGGTRTGTGGAGTACTTTGG | NEUROPATHY, HEREDITARY SENSORY, TYPE IC |
| 796051870 | SQSTM1 | NM_003900.4(SQSTM1):c.970_1165del | CGCCAGRCAAGTGAACCAAGAG | Paget disease of bone, familial |
| 776749939 | SQSTM1 | NM_003900.4(SQSTM1):c.1160C>T (p.Pro387Leu) | CCTTGTACCCACATCTCCYGCCA | FRONTOTEMPORAL DEMENTIA AND/OR AMYOTROPHIC LATERAL SCLEROSIS 3 |
| 147810437 | SQSTM1 | NM_001142298.1(SQSTM1):c.98C>T (p.Ala33Val) | CCACCGTGTGCTCAGGAGGYGCC, CCGTGTGCTCAGGAGGYGCCCCG | FRONTOTEMPORAL DEMENTIA AND/OR AMYOTROPHIC LATERAL SCLEROSIS 3 |
| 121913314 | SRC | NM_198291.2(SRC):c.1591C>T (p.Gln531Ter) | CCACCGAGCCCCAGTACYAGCCC, CCGAGCCCCAGTACYAGCCCGGG | |
| 199469464 | SRCAP | NM_006662.2(SRCAP):c.7330C>T (p.Arg2444Ter) | CCAGCACCTAGGCCTYGACCCAC | Floating-Harbor syndrome |
| 587777656 | SRCAP | NM_006662.2(SRCAP):c.7000C>T (p.Gln2334Ter) | CCGAGAGGAGCTCAAAYAGGCAG | Floating-Harbor syndrome |
| 121434246 | SRD5A2 | NM_000348.3(SRD5A2):c.344G>A (p.Gly115Asp) | AGAGRCACTGCCTTCTGCACTGG | 3-Oxo-5 alpha-steroid delta 4-dehydrogenase deficiency |
| 121434250 | SRD5A2 | NM_000348.3(SRD5A2):c.586G>A (p.Gly196Ser) | TCCTCRGTGAGATCATTGAATGG | 3-Oxo-5 alpha-steroid delta 4-dehydrogenase deficiency |
| 104894965 | SRY | NM_003140.2(SRY):c.209G>A (p.Trp70Ter) | TCGTGTRGTCTCGCGATCAGAGG | 46,XY sex reversal, type 1 |
| 104894966 | SRY | NM_003140.2(SRY):c.337G>A (p.Ala113Thr) | CCAGGAGRCACAGAGAAATTACAG | 46,XY sex reversal, type 1 |
| 104894967 | SRY | NM_003140.2(SRY):c.320G>A (p.Trp107Ter) | AAAATRGCCATTCTTCCAGGAGG, CGAAAAATRGCCATTCTTCCAGG | 46,XY sex reversal, type 1 |
| 104894969 | SRY | NM_003140.2(SRY):c.192G>A (p.Met64Ile) | CCATRAACGCATTCATCGTGTGG | 46,XY sex reversal, type 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104894977 | SRY | NM_003140.2(SRY):c.4C>T (p.Gln2Ter) | CCTTGTTTTTGACAATGYAATCA | 46,XY sex reversal, type 1 |
| 104893668 | ST3GAL5 | NM_003896.3(ST3GAL5):c.862C>T (p.Arg288Ter) | CCTTAGCCATTCTGGGTAYGACT | Amish infantile epilepsy syndrome |
| 534438354 | ST3GAL5 | NM_003896.3(ST3GAL5):c.1063G>A (p.Glu355Lys) | CCCGCCAAACTGACTTYATCGCA, CCGCCAAACTGACTTYATCGCAC | Amish infantile epilepsy syndrome |
| 397509388 | STAMBP | NM_201647.2(STAMBP):c.532C>T (p.Arg178Ter) | CCAGGAGCTAGAAAAAGAGYGAC | Microcephaly-capillary malformation syndrome |
| 397509390 | STAMBP | NM_201647.2(STAMBP):c.1270C>T (p.Arg424Ter) | CCATCACAGACCTTYGATGAGCG | Microcephaly-capillary malformation syndrome |
| 143739249 | STAMBP | NM_201647.2(STAMBP):c.112C>T (p.Arg38Cys) | CCACCCGTCGGTACTTCYGCTC, CCCCGTCGGTACTTCYGCTCTGG, CCCGTCGGTACTTCYGCTCTGA | Microcephaly-capillary malformation syndrome |
| 104894085 | STAR | NM_000349.2(STAR):c.772C>T (p.Gln258Ter) | CCAAGAGCATCATCAACYAGGT, CAAGAGCATCATCAACYAGGTC | Cholesterol monooxygenase (side-chain cleaving) deficiency |
| 104894090 | STAR | NM_000349.2(STAR):c.562C>T (p.Arg188Cys) | CCGTGACTTTGTGAGCGYGCT | Cholesterol monooxygenase (side-chain cleaving) deficiency |
| 387906759 | STAT1 | NM_007315.3(STAT1):c.800C>T (p.Ala267Val) | CCCAGGTTCACTATAGTTGYGGA, CCAGGTTCACTATAGTTGYGGAG | Immunodeficiency 31C |
| 587777647 | STAT3 | NM_003150.3(STAT3):c.2147C>T (p.Thr716Ile) | CAGRTCGTTCTGTAGGAAATGGG, GCAGRTCGTTCTGTAGGAAATGG | Autoimmune disease, multisystem, infantile-onset |
| 113994135 | STAT3 | NM_139276.2(STAT3):c.1144C>T (p.Arg382Trp) | CCCCTGTGATTCAGATCCYGGAA, CCTGTGATTCAGATCCYGGAAA, CCTGTGATTCAGATCCYGGAAAT | Hyperimmunoglobulin E syndrome |
| 121908502 | STAT5B | NM_012448.3(STAT5B):c.454C>T (p.Arg152Ter) | CCAGACGTTTGAGGAGCTGYGAC | Growth hormone insensitivity with immunodeficiency |
| 397515390 | STIM1 | NM_003156.3(STIM1):c.970-1G>A | CCTARGTTCGGAGGCCTTGAGG | Immune dysfunction with T-cell inactivation due to calcium entry defect 2 |
| 483352867 | STIM1 | NM_003156.3(STIM1):c.910C>T (p.Arg304Trp) | CCAGCGGCTGAAGGAGCTGYGGG | Stormorken syndrome |
| 730081979 | STK11 | NM_000455.4(STK11):c.526G>A (p.Asp176Asn) | TGCACAAGRACATCAAGCCGGGG | Hereditary cancer-predisposing syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121913323 | STK11 | NM_000455.4(STK11):c.508C>T (p.Gln170Ter) | CCTGGAGTACCTGCATAGCYAGG | Cutaneous malignant melanoma 1 |
| 786201090 | STK11 | NM_000455.4(STK11):c.910C>T (p.Arg304Trp) | CCATCCGGCAGATCYGGCAGCAC | Hereditary cancer-predisposing syndrome |
| 397514639 | STRAG | NM_001142617.1(STRA6):c.1964G>A (p.Arg655His) | TTCCRCAAGACGGCCCTGTTGGG, CTTCCRCAAGACGGCCCTGTGG | Microphthalmia syndromic 9 |
| 267607096 | STRA6 | NM_001142617.1(STRA6):c.69G>A (p.Trp23Ter) | CTGRTACATCGATGAGCCCCAGG | Microphthalmia syndromic 9 |
| 118203959 | STRA6 | NM_001142617.1(STRA6):c.1963C>T (p.Arg655Cys) | CCCAACCCTGCAGGTCTTCYGCA, CCAACCCTGCAGGTCTTCYGCAA, CCCTGCAGGTCTTCYGCAAGACG | Microphthalmia syndromic 9 |
| 118203961 | STRA6 | NM_001142617.1(STRA6):c.269C>T (p.Pro90Leu) | CCTTGCCTCTGTGCTAGCCYTGT, CCTCTGTGCTAGCCYTGTGGATT | Microphthalmia syndromic 9 |
| 377480477 | STRC | NM_153700.2(STRC):c.4402C>T (p.Arg1468Ter) | CCTCRTACATCTGCACAATTTGG | Deafness, autosomal recessive 16 |
| 137853167 | STS | NM_000351.4(STS):c.1022C>T (p.Ser341Leu) | CCCTCATCTACTTCACATYGGAC, CCTCATCTACTTCACATYGGACC | X-linked ichthyosis with steryl-sulfatase deficiency |
| 587777346 | STUB1 | NM_005861.3(STUB1):c.235G>A (p.Ala79Thr) | AGCAGRCCCTGGCCGACTGCCGG | Spinocerebellar ataxia, autosomal recessive 16 |
| 587777310 | STXBP1 | NM_003165.3(STXBP1):c.847G>A (p.Glu283Lys) | TGGACRAGGACGACGACCTGTGG | Early infantile epileptic encephalopathy 4 |
| 796053356 | STXBP1 | NM_003165.3(STXBP1):c.569G>A (p.Arg190Gln) | GCTGTGCRGTATCGGGGGTAAGG | not provided |
| 796053360 | STXBP1 | NM_003165.3(STXBP1):c.795-1G>A | CATTCTARGTATGAGACCAGCGG | not provided |
| 796053365 | STXBP1 | NM_003165.3(STXBP1):c.1061G>A (p.Cys354Tyr) | GACTRTATGAAGCATTACCAAGG | not provided |
| 121918318 | STXBP1 | NM_003165.3(STXBP1):c.539G>A (p.Cys180Tyr) | GACCCTTRTGCCACCCTGAAGG | Early infantile epileptic encephalopathy 4 |
| 796053366 | STXBP1 | NM_003165.3(STXBP1):c.1099C>T (p.Arg367Ter) | CCGTAGACAAACTCTGCYGAGTG | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAa11 | Phenotypes |
|---|---|---|---|---|
| 796053376 | STXBP1 | NM_003165.3(STXBP1):c.1672C>T (p.Gln558Ter) | CCTACGAGGTGACCYAGGCCAAC | not provided |
| 28942088 | SUFU | NM_016169.3(SUFU):c.44C>T (p.Pro15Leu) | CGGGRGCGCGGTGGGGCCGGG, CCGGGRGCGCGGTGGGGCCGGG, GCCGGGRGCGCGGTGGGGCCGG, GGCCGGGRGCGCGGTGGGGCCG | Medulloblastoma |
| 137852854 | SUMF1 | NM_182760.3(SUMF1):c.653G>A (p.Cys218Tyr) | ACTRCACTTGGGCAGGGAAGCGG | Multiple sulfatase deficiency |
| 137852845 | SUMF1 | NM_182760.3(SUMF1):c.979C>T (p.Arg327Ter) | CCCCCTTCTGGGAAAGACYGAGT, CCCTTCTGGGAAAGACYGAGTG, CCCTTCTGGGAAAGACYGAGTGA, CCTTCTGGGAAAGACYGAGTGAA | Multiple sulfatase deficiency |
| 121908009 | SUOX | NM_000456.2(SUOX):c.1589G>A (p.Gly530Asp) | GAGRTGTTCTCAGCAATGCCTGG | Sulfite oxidase deficiency, isolated |
| 397514679 | SYN1 | NM_006950.3(SYN1):c.1663C>T (p.Gln555Ter) | CCCGCCTCTCCGTTCCYAGCG, CCGCCTCTCCGTTCCYAGCGC, CCTCCCGTCCYAGCGCCAG | Epilepsy, X-linked, with variable learning disabilities and behavior disorders |
| 397514670 | SYNGAP1 | NM_066772.2(SYNGAP1):c.1685C>T (p.Pro562Leu) | CCCCCAGCGTGTTCCYGAGGGA, CCCCAGCGTGTTCCYGAGGGAG, CCCAGCGTGTTCCYGAGGAGC | Mental retardation, autosomal dominant 5 |
| 398122403 | SYNJ1 | NM_203446.2(SYNJ1):c.773G>A (p.Arg258Gln) | GTCCRGGGAACAAATGATGATGG | Parkinson disease 20, early-onset |
| 267607101 | TAB2 | NM_015093.5(TAB2):c.622C>T (p.Pro208Ser) | CCACCTGTACTTAACAGTYCACA, CCTGTACTTAACAGTYCACAGGG | Congenital heart disease, multiple types, 2 |
| 144292455 | TACR3 | NM_001059.2(TACR3):c.824G>A (p.Trp275Ter) | CCTGGGATTTCTCCTCCCYAGAG | Hypogonadotropic hypogonadism 11 with or without anosmia |
| 80358223 | TACSTD2 | NM_002353.2(TACSTD2):c.352C>T (p.Gln118Ter) | CCGCTTCAAGGCGCYAGTGCA | Lattice corneal dystrophy Type III |
| 80358224 | TACSTD2 | NM_002353.2(TACSTD2):c.619C>T (p.Gln207Ter) | CCAGATCGAGCTGCGYAGAAACA | Lattice corneal dystrophy Type III |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397509359 | TAF1 | NR_104387.1(TAF1):n.589 4C>T | CCAAGGCTTTGAGTCTCTTYGTC | Dystonia 3, torsion, X-linked |
| 4884357 | TARDBP | NM_007375.3(TARDBP):c. 892G>A (p.Gly298Ser) | GCTRTTTTGGGAAACAATCAAGG | Amyotrophic lateral sclerosis type 10 |
| 387906334 | TARDBP | NM_007375.3(TARDBP):c. *697G>A | ATCCRCTACTCTTTATTTCATGG | Amyotrophic lateral sclerosis type 10, FRONTOTEMPORAL DEMENTIA WITH TDP43 INCLUSIONS, TARDBP-RELATED |
| 794729167 | TAZ | NM_000116.4(TAZ):c.582 G>A (p.Trp194Ter) | TCAAGTGRGGTAAGGGCTGCTGG | not provided |
| 794729174 | TAZ | NM_000116.4(TAZ):c.526 C>T (p.His176Tyr) | CCATGGGGACTGGGTGYATATCT | not provided |
| 587777157 | TBC1D20 | NM_144628.3(TBC1D20):c. 199C>T (p.Arg67Ter) | TTCRTCTGATCTCATCAGTCAGG | Warburg micro syndrome 4 |
| 398122968 | TBC1D24 | NM_001199107.1(TBC1D2 4):c.1206+5G>A | TGARCAGGGGCCCTGGAGCCAGG | Digitorenocerebral syndrome |
| 483352866 | TBC1D24 | NM_001199107.1(TBC1D2 4):c.533C>T (p.Ser178Leu) | CCTGCCCTTTGAGTYGTCCTGCA | Deafness, autosomal recessive 86, Deafness, autosomal dominant 65 |
| 748112833 | TBK1 | NM_013254.3(TBK1):c.208 6G>A (p.Glu696Lys) | AAAGGAARAGATGAAGGGGTG G | FRONTOTEMPORAL DEMENTIA AND/OR AMYOTROPHIC LATERAL SCLEROSIS 4 |
| 137852955 | TBX20 | NM_001077653.2(TBX20): c.583C>T (p.Gln195Ter) | CCTTTTACCGGTGAGYAACTACT | Atrial septal defect 4 |
| 104894648 | TBX4 | NM_018488.2(TBX4):c.184 C>T (p.Gln62Ter) | CCGCCGCCGCCGGAGYAGGTA, CCGCCGCCGCCGGAGYAGGTAGG G | Ischiopatellar dysplasia |
| 104894382 | TBX5 | NM_000192.3(TBX5):c.709 C>T (p.Arg237Trp) | CCCTTTGCCAAAGGATTTYGGGG, CCTTTGCCAAAGGATTTYGGGGC | Holt-Oram syndrome, Malformation of the heart, not provided |
| 199422117 | TBXAS1 | NM_001061.4(TBXAS1):c. 1238G>A (p.Arg413Gln) | ATTCACACRGGAGGCAGCTCAGG | not provided |
| 775636212 | TCAP | NM_003673.3(TCAP):c.20 8C>T (p.Arg70Trp) | CCCTGGCTGATGATGYGGATGGG, CCTGGCTGATGATGYGGATGGGC | Dilated cardiomyopathy 1N, Hypertrophic cardiomyopathy |
| 777518512 | TCAP | NM_003673.3(TCAP):c.25 9C>T (p.Arg87Trp) | CCAGCTGCCCTACCAGYGGGTAC | not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 398123560 | TCF4 | NM_001083962.1(TCF4):c. 1086G>A (p.Trp362Ter) | TTGRTCTAGAAATGAGGACAGG, GCTGTTTGRTCTAGAAATGAGG | Pitt-Hopkins syndrome |
| 121909120 | TCF4 | NM_001083962.1(TCF4):c. 1738C>T (p.Arg580Trp) | CCCGAGAGCGTCTGYGGGTCCGT | Pitt-Hopkins syndrome |
| 727505396 | TCF4 | NM_001083962.1(TCF4):c. 1438C>T (p.Gln480Ter) | CCACAGCTTCCTGTCYAGTCTGC | Pitt-Hopkins syndrome |
| 139617644 | TCIRG1 | NM_006019.3(TCIRG1):c.1 674-1G>A | CCGCCARGCACTTTGGCCAGAGG | Osteopetrosis autosomal recessive 1 |
| 137853150 | TCIRG1 | NM_006019.3(TCIRG1):c.1 213G>A (p.Gly405Arg) | TGTTCRGGGATGTGGGCCACGGG, ATGTTCRGGGATGTGGGCCACGG | Osteopetrosis autosomal recessive 1 |
| 119470017 | TCOF1 | NM_000356.3(TCOF1):c.2 731C>T (p.Arg911Ter) | CCCCGAGGAAGGCCYGAGCCTCG | Treacher collins syndrome 1 |
| 267607107 | TECTA | NM_005422.2(TECTA):c.5 471G>A (p.Gly1824Asp) | CAGTCGRTTTTGAGAGGGAGGG, CCAGCTCGRTTTTGAGAGGGAGG | Deafness, autosomal dominant 12 |
| 281865415 | TECTA | NM_005422.2(TECTA):c.5 458C>T (p.Leu1820Phe) | CCATATCTAAGTGCAAGYTCTTC | Deafness, autosomal dominant 12 |
| 387906745 | TEK | NM_000459.4(TEK):c.2744 G>A (p.Arg915His) | CCTTCRCAAGAGCCCTGTGCTGG | Multiple Cutaneous and Mucosal Venous Malformations |
| 199422287 | TERC | NR_001566.1(TERC):n.450 G>A | CATRCAGTTCGCTTTCCTGTTGG | Aplastic anemia |
| 199422280 | TERC | NR_001566.1(TERC):n.322 G>A | GTCAGCCRCGGGTCTCTCGGGGG, TGTCAGCCRCGGGTCTCTCGGGG | Aplastic anemia |
| 199422260 | TERC | NR_001566.1(TERC):n.35 C>T | CCTGGGAGGGGTGGTGGYCATTT | Dyskeratosis congenita autosomal dominant |
| 199422291 | TERT | NM_198253.2(TERT):c.430 G>A (p.Val144Met) | CCGRTGGGCGACACGTGCTGG | Idiopathic fibrosing alveolitis, chronic form |
| 149566858 | TERT | NM_198253.2(TERT):c.217 7C>T (p.Thr726Met) | CCTCCRTGAGCCTGTCCTGGGGG, ACCTCCRTGAGCCTGTCCTGGGG, GACCTCCRTGAGCCTGTCCTGGG, TGACCTCCRTGAGCCTGTCCTGG | Dyskeratosis congenita autosomal dominant |
| 121918662 | TERT | NM_198253.2(TERT):c.208 0G>A (p.Val694Met) | CACCTTCRTGCGTGCGGG, GCACCTTCRTGCGTGCGGTGCGG | Aplastic anemia, PULMONARY FIBROSIS AND/OR BONE MARROW FAILURE, TELOMERE-RELATED, 1 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121918664 | TERT | NM_198253.2(TERT):c.326 8G>A (p.Val1090Met) | TCACCTACRTGCCACTCCTGGGG | Aplastic anemia, PULMONARY FIBROSIS AND/OR BONE MARROW FAILURE, TELOMERE-RELATED, 1 |
| 199422294 | TERT | NM_198253.2(TERT):c.189 2G>A (p.Arg631Gln) | GCTGCRGCCGATTGTGAACATGG | Idiopathic fibrosing alveolitis, chronic form, Dyskeratosis congenita, autosomal dominant, 2 |
| 199422295 | TERT | NM_198253.2(TERT):c.204 5G>A (p.Gly682Asp) | TGGRCCTGGACGATATCCACAGG | Dyskeratosis congenita autosomal dominant |
| 199422309 | TERT | NM_198253.2(TERT):c.219 +1G>A | CAGRTGGGCCTCCCCGGGTCGG, CGGCCAGRTGGGCCTCCCCGGGG, TCCGCCAGRTGGGCCTCCCCGGG | Idiopathic fibrosing alveolitis, chronic form, PULMONARY FIBROSIS AND/OR BONE MARROW FAILURE, TELOMERE-RELATED, 1 |
| 199422293 | TERT | NM_198253.2(TERT):c.145 6C>T (p.Arg486Cys) | CCAGGCACAACAGCAACGCYGCTTC | Idiopathic fibrosing alveolitis, chronic form |
| 199422297 | TERT | NM_198253.2(TERT):c.211 0C>T (p.Pro704Ser) | CCCAGGACCCGCCGYCTGAGCTG | Dyskeratosis congenita autosomal dominant, Dyskeratosis congenita, autosomal recessive, 4 |
| 199422301 | TERT | NM_198253.2(TERT):c.243 1C>T (p.Arg811Cys) | CCTCTTCGACGTCTTCCTAYGCT | Dyskeratosis congenita autosomal recessive 1, Dyskeratosis congenita, autosomal recessive, 4 |
| 141425941 | TERT | NM_198253.2(TERT):c.237 1G>A (p.Val791Ile) | CCCAGACCTGCTCTGATGAYGACG, CCAGACCTGCTCTGATGAYGACGG | PULMONARY FIBROSIS AND/OR BONE MARROW FAILURE, TELOMERE-RELATED, 1 |
| 121918676 | TF | NM_001063.3(TF):c.830G>A (p.Gly277Asp) | GCGRCAAGGAGGACTTGATCTGG | |
| 121918681 | TF | NM_001063.3(TF):c.229G>A (p.Asp77Asn) | CGAAGCGRATGCTGTGACACTGG | Atransferrinemia |
| 80338876 | TFR2 | NM_003227.3(TFR2):c.64 G>A (p.Val22Ile) | ACCRTCTACCAGCGTGTGGAAGG, TCAGACCRTCTACCAGCGTGTGG | Hemochromatosis type 3 |
| 80338881 | TFR2 | NM_003227.3(TFR2):c.949 C>T (p.Gln317Ter) | CCAAGCCTGTCCAGCCAGYAGGC | Hemochromatosis type 3 |
| 80338882 | TFR2 | NM_003227.3(TFR2):c.118 6C>T (p.Arg396Ter) | CCTGGGCCCCGGGCCAYGACTGC | Hemochromatosis type 3 |
| 121912650 | TG | NM_003235.4(TG):c.7007 G>A (p.Arg2336Gln) | AGCTACCRAGTGGGTGTCTTCGG | Iodotyrosyl coupling defect |
| 121912646 | TG | NM_003235.4(TG):c.4588C>T (p.Arg1530Ter) | CCAGAATGGCCAGTAYGAGCCA | Iodotyrosyl coupling defect |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909209 | TGFBI | NM_000358.2(TGFBI):c.1664G>A (p.Arg555Gln) | AGAGAACRGAGCAGACTCTTGGG, AAGAGAACRGAGCAGACTCTTGG | Thiel-Behnke corneal dystrophy |
| 121909208 | TGFBI | NM_000358.2(TGFBI):c.1663C>T (p.Arg555Trp) | CCCTGCCACCAAGAGAAYGGAG C, CCTGCCACCAAGAGAAYGGAGC A | Groenouw corneal dystrophy type I |
| 121918712 | TGFBR1 | NM_004612.3(TGFBR1):c.599C>T (p.Thr200Ile) | CCATTGCTTGTTCAGAGAYAAT | Loeys-Dietz syndrome 1 |
| 111854391 | TGFBR1 | NM_004612.3(TGFBR1):c.722C>T (p.Ser241Leu) | CCTTCTAGAGAAGAACGTTYGTGG | Loeys-Dietz syndrome, Loeys-Dietz syndrome 1 |
| 104893816 | TGFBR2 | NM_003242.5(TGFBR2):c.1379G>A (p.Arg460His) | TCTCRCTGTAATGCAGTGGGAGG, ACATCTCRCTGTAATGCAGTGGG, GACATCTCRCTGTAATGCAGTGG | Loeys-Dietz syndrome 2, not provided |
| 104893809 | TGFBR2 | NM_003242.5(TGFBR2):c.1609C>T (p.Arg537Cys) | CCCAGTGTGTGGCAGAAYGCTTC, CCAGTGTGTGGCAGAAYGCTTCA | Loeys-Dietz syndrome 2, not provided |
| 104893810 | TGFBR2 | NM_003242.5(TGFBR2):c.1582C>T (p.Arg528Cys) | CCACGACCCAGAGGCCYGTCTCA | Loeys-Dietz syndrome 2, not provided |
| 35312232 | TGM1 | NM_000359.2(TGM1):c.1552G>A (p. Val518Met) | TATRTGGAGAGAGGCCATCGG | Autosomal recessive congenital ichthyosis 1 |
| 121918717 | TGM1 | NM_000359.2(TGM1):c.968G>A (p.Arg323Gln) | CTCCCRGGTCATCTCTGCCATGG | Autosomal recessive congenital ichthyosis 1 |
| 121918722 | TGM1 | NM_000359.2(TGM1):c.1147G>A (p. Val383Met) | GGCRTGACCACCACAGGTAGTGG | Autosomal recessive congenital ichthyosis 1 |
| 121918725 | TGM1 | NM_000359.2(TGM1):c.832G>A (p.Gly278Arg) | TACRGGACCGAAGCACAGATTGG | Autosomal recessive congenital ichthyosis 1 |
| 121918727 | TGM1 | NM_000359.2(TGM1):c.857G>A (p.Arg286Gln) | GGTGAGCRGACCTGGAACTACGG | Autosomal recessive congenital ichthyosis 1 |
| 398122904 | TGM1 | NM_000359.2(TGM1):c.2278C>T (p.Arg760Ter) | CCAGTCGTTTGTGCCTGTGYGAC | Autosomal recessive congenital ichthyosis 1 |
| 372250159 | TGM6 | NM_198994.2(TGM6):c.331C>T (p.Arg111Cys) | CCCAGTGCTGTCATTGGCYGCTA, CCAGTGCTGTCATTGGCYGCTAC | Spinocerebellar ataxia 35 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121917764 | TH | NM_199292.2(TH):c.941C>T (p.Thr314Met) | CCCCTTGCAGAGCGCAYGGGCTT, CCCTTGCAGAGCGCAYGGGCTTC, CCTTGCAGAGCGCAYGGGCTTCC | Segawa syndrome, autosomal recessive |
| 121918694 | THRB | NM_001128177.1(THRB):c.700G>A (p.Ala234Thr) | CCAACRCCCAAGGCAGCCACTGG | Thyroid hormone resistance, generalized, autosomal dominant |
| 121918698 | THRB | NM_001128177.1(THRB):c.1313G>A (p.Arg438His) | CAGCCRCTTCCTGCACATGAAGG | Thyroid hormone resistance, generalized, autosomal dominant |
| 121918696 | THRB | NM_001128177.1(THRB):c.958C>T (p.Arg320Cys) | CCCTTCGCGCTGCTGTGYGCTAT, CCTTCGCGCTGCTGTGYGCTATG | Thyroid hormone resistance, generalized, autosomal dominant |
| 121918707 | THRB | NM_001128177.1(THRB):c.727C>T (p.Arg243Trp) | CCACTGGAAGCAAAAAYGGAAAT | Thyroid hormone resistance, generalized, autosomal dominant |
| 1054894 | TIMM8A | NM_004085.3(TIMM8A):c.238C>T (p.Arg80Ter) | CCAGTTCATCTTGAATYGACTGG | Mohr-Tranebjaerg syndrome |
| 80356559 | TIMM8A | NM_004085.3(TIMM8A):c.112C>T (p.Gln38Ter) | CCAGCAGCTGGTGCACYAGATGA | Mohr-Tranebjaerg syndrome |
| 199422321 | TINF2 | NM_001099274.1(TINF2):c.706C>T (p.Pro236Ser) | CCCTGCCAAAGCCAAGYCTGG, CCCTTGCCAAAGCCAAGYCTGGC, CCTGCCAAAGCCAAGYCTGCA | Dyskeratosis congenita autosomal dominant |
| 387907154 | TINF2 | NM_001099274.1(TINF2):c.811C>T (p.Gln271Ter) | CCGACGAAGAGTTCAGTCYTCYAAT | Dyskeratosis congenita, autosomal dominant, 3 |
| 281865496 | TK2 | NM_004614.4(TK2):c.575G>A (p.Arg192Lys) | AGARGTTAAAGAAGAGATGCAGG | Mitochondrial DNA depletion syndrome 2 |
| 281865489 | TK2 | NM_004614.4(TK2):c.268C>T (p.Arg90Cys) | CCAAGTGAGAAATGTCYGTGGC | Mitochondrial DNA depletion syndrome 2 |
| 281865493 | TK2 | NM_004614.4(TK2):c.388C>T (p.Arg130Trp) | CCTTTAGGTCATCTGTAYGGT | Mitochondrial DNA depletion syndrome 2 |
| 137854431 | TK2 | NM_004614.4(TK2):c.323C>T (p.Thr108Met) | CCTCTCGCTGGGGTCTTAYGCTA | Mitochondrial DNA depletion syndrome 2, not provided |
| 121908327 | TMC6 | NM_007267.6(TMC6):c.280C>T (p.Arg94Ter) | CCTCCATAGGCCCAGCYGAGGT, CCATAGGCCCAGCYGAGGTGCC | Epidermodysplasia verruciformis |
| 387907134 | TMEM138 | NM_016464.4(TMEM138):c.376G>A (p.Ala126Thr) | ACTARGTAAGGACCAGAGCAAGG | Joubert syndrome 16 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907133 | TMEM138 | NM_016464.4(TMEM138): c.380C>T (p.Ala127Val) | CCTCCCCAGCAGYAGTGTTGT | Joubert syndrome 16 |
| 387907221 | TMEM165 | NM_018475.4(TMEM165): c.377G>A (p.Arg126His) | AACCRCCTGACCGTCTGGCTGG, CTATAACCRCCTGACCGTGCTGG | Congenital disorder of glycosylation type 2k |
| 587777610 | TMEM173 | NM_198282.3(TMEM173): c.463G>A (p.Val155Met) | CCAGCCCATGCGGCCAYGTTGAAA | Sting-associated vasculopathy, infantile-onset |
| 199469707 | TMEM237 | NM_001044385.2(TMEM237):c.52C>T (p.Arg18Ter) | CCGCCACAGCGTCTCCAYGAGC, CCACAGCGTCTCCAYGAGCTCT | Familial aplasia of the vermis, Joubert syndrome 14 |
| 606231454 | TMEM240 | NM_001114748.1(TMEM240):c.239C>T (p.Thr80Met) | CCGAGAACTACTTTGYAYGGAC | Spinocerebellar ataxia 21 |
| 606231453 | TMEM240 | NM_001114748.1(TMEM240):c.346C>T (p.Arg116Cys) | CCTGCACTGCGCCGTGYGCGCCT | Spinocerebellar ataxia 21 |
| 637750743 | TMEM43 | NM_024334.2(TMEM43):c.1073C>T (p.Ser358Leu) | CCTTCTGTGTGGCCACCTYGCTG | Arrhythmogenic right ventricular cardiomyopathy, Arrhythmogenic right ventricular cardiomyopathy, type 5, not provided |
| 267607114 | TMEM67 | NM_001142301.1(TMEM67):c.1391G>A (p.Gly464Glu) | CAGRATGCGAAGAGGCGCATTGG, GCAGRATGGAAGAGGCGCATTGG | Joubert syndrome 6 |
| 267607118 | TMEM67 | NM_153704.5(TMEM67):c.130C>T (p.Gln44Ter) | CCTTCTCTTTCCCTTTCYAGCAG | Joubert syndrome 6 |
| 28941781 | TMIE | NM_147196.2(TMIE):c.274C>T (p.Arg92Trp) | CCGGAAGGAGATCGAAGCCYGG T | Deafness, autosomal recessive 6 |
| 121908059 | TMPRSS15 | NM_002772.2(TMPRSS15):c.2569C>T (p.Arg857Ter) | CCTCAAACAGTCCCTYGATTAAT | Enterokinase deficiency |
| 181949335 | TMPRSS3 | NM_024022.2(TMPRSS3):c.916G>A (p.Ala306Thr) | CCGGCCAGCTTCATAAGGYGAT, CCAGCTTCATAAGGYGATGTCA | Deafness, autosomal recessive 8 |
| 374793617 | TMPRSS3 | NM_024022.2(TMPRSS3):c.323-6G>A | CCACCCACCCGGACTGGCYGATG, CCCACCCGGACTGGCYGATGTGC, CCACCCGGACTGGCYGATGTGCA | Deafness, autosomal recessive 8 |
| 137853119 | TMPRSS6 | NM_153609.3(TMPRSS6):c.1324G>A (p.Gly442Arg) | CCTCACCRGCCCGTGTGCGGG, CCCTCACCRGCCCGTGTGCGG | Microcytic anemia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 137853120 | TMPRSS6 | NM_153609.3(TMPRSS6): c.1561G>A (p.Asp521Asn) | CAGCRACGAAGAGACAGTGCCAG G | Microcytic anemia |
| 387907018 | TMPRSS6 | NM_153609.3(TMPRSS6): c.1564G>A (p.Glu522Lys) | GACRAAGAGCAGTGCCAGGAAG G, CAGCGACRAAGAGACAGTGCCAG G | Microcytic anemia |
| 137853123 | TMPRSS6 | NM_153609.3(TMPRSS6): c.1795C>T (p.Arg599Ter) | CCTCCAGGTTCGGGGTYGACACA | Microcytic anemia |
| 281865419 | TNF | NM_000594.3(TNF):c.322 C>T (p.Arg108Trp) | CCAGTGGCTGAACCGCYGGGCCA | |
| 104895222 | TNFRSF1A | NM_001065.3(TNFRSF1A) :c.350G>A (p.Cys117Tyr) | CTCTTCTTRCACAGTGGACCGGG | TNF receptor-associated periodic fever syndrome (TRAPS) |
| 104895218 | TNFRSF1A | NM_001065.3(TNFRSF1A) :c.185G>A (p.Cys62Tyr) | ACCAAGTRCCACAAAGGTAGGG G, TACCAAGTRCCACAAAGGTAGGG | TNF receptor-associated periodic fever syndrome (TRAPS) |
| 587777075 | TNFRSF4 | NM_003327.3(TNFRSF4):c. 193C>T (p.Arg65Cys) | CGGACRGCACACCGTGTTCTGGG, ACGGACRGCACACCGTGTTCTGG | Immunodeficiency 16 |
| 104894312 | TNNI2 | NM_003282.3(TNNI2):c.46 6C>T (p.Arg156Ter) | CCACAGGAGCGGGGACCTGYGAG A | Distal arthrogryposis type 2B, not provided |
| 727503503 | TNNI3 | NM_000363.4(TNNI3):c.50 9G>A (p.Arg170Gln) | CCTGCRGGCCCACCTCAAGCAGG | Familial restrictive cardiomyopathy 1, Cardiomyopathy, Familial hypertrophic cardiomyopathy 7 |
| 397516355 | TNNI3 | NM_000363.4(TNNI3):c.54 4G>A (p.Glu182Lys) | GACACCRAGAAGGTGAGTGTGG G, GGACACCRAGAAGGTGAGTGTG G | Dilated cardiomyopathy 1FF, Cardiomyopathy |
| 397516357 | TNNI3 | NM_000363.4(TNNI3):c.55 7G>A (p.Arg186Gln) | AAAACCRGGAGGTGGGAGACTG G | Primary familial hypertrophic cardiomyopathy, Cardiomyopathy, Hypertrophic cardiomyopathy, Familial hypertrophic cardiomyopathy 7 |
| 1219177761 | TNNI3 | NM_000363.4(TNNI3):c.51 1G>A (p.Ala171Thr) | CCTGCRGGRCCCACCTCAAGCAGG | Familial restrictive cardiomyopathy 1, not specified |
| 730881069 | TNNI3 | NM_000363.4(TNNI3):c.40 7G>A (p.Arg136Gln) | ACCTTCRAGGCAAGTTTAAGCGG | Cardiomyopathy, Hypertrophic cardiomyopathy |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 727504242 | TNNI3 | NM_000363.4(TNNI3):c.497C>T (p.Ser166Phe) | CCCGGGCTAAGGAGTYCCTGGAC, CCGGGCTAAGGAGTYCCTGACC | Cardiomyopathy, not specified |
| 267607128 | TNNI3 | NM_000363.4(TNNI3):c.61C>T (p.Arg21Cys) | CCAGCCCCAATCAGAYGCCCCTC | Familial hypertrophic cardiomyopathy 7 |
| 727504247 | TNNT2 | NM_001001430.2(TNNT2):c.860G>A (p.Trp287Ter) | CGGGCGCTRGAAATAGAGCCTGG | Familial hypertrophic cardiomyopathy 2, Cardiomyopathy |
| 121964856 | TNNT2 | NM_001001430.2(TNNT2):c.275G>A (p.Arg92Gln) | CCACCRGAAGCGCATGGAGAGAG | Familial hypertrophic cardiomyopathy 2, Cardiomyopathy |
| 45501500 | TNNT2 | NM_001001430.2(TNNT2):c.476G>A (p.Arg159Gln) | GACRAGAGGAGGAGGAGAACAGG | Cardiomyopathy, not specified |
| 730881101 | TNNT2 | NM_001001430.2(TNNT2):c.422G>A (p.Arg141Gln) | CATCCRGAATGAGCGGGAGAAGG | Cardiomyopathy |
| 121964857 | TNNT2 | NM_000364.3(TNNT2):c.853C>T (p.Arg285Cys) | CCCCTGCAGCTCCAAGACCYGCG, CCCTGCAGCTCCAAGACCYGCGG, CCTGCAGCTCCAAGACCYGCGGG | Costello syndrome, Primary familial hypertrophic cardiomyopathy, Familial hypertrophic cardiomyopathy 2, Familial hypertrophic cardiomyopathy 1, Cardiomyopathy, not specified |
| 397516456 | TNNT2 | NM_001001430.2(TNNT2):c.274C>T (p.Arg92Trp) | CCACCCAGGACATCCACYGGA, CCCAGGACATCCACYGGAAGC, CCACAGGACATCCACYGGAAGCG | Familial hypertrophic cardiomyopathy 2, Cardiomyopathy |
| 727504245 | TNNT2 | NM_001001430.2(TNNT2):c.311C>T (p.Ala104Val) | CCTGAATGAGTTGCAGGYGCTGA | Familial hypertrophic cardiomyopathy 2, Cardiomyopathy, not specified |
| 74315380 | TNNT2 | NM_001001430.2(TNNT2):c.391C>T (p.Arg131Trp) | CCTTAGGAGAGACGTYGGGCAGA | Primary dilated cardiomyopathy, Left ventricular noncompaction 6, Cardiomyopathy |
| 587777682 | TNXB | NM_019105.6(TNXB):c.12214C>T (p.Arg4072Cys) | CATGCGGCRCTGGAACACCTGGG | Ehlers-Danlos-like syndrome due to tenascin-X deficiency |
| 587777684 | TNXB | NM_019105.6(TNXB):c.3991G>A (p.Gly1331Arg) | CCTGCCACGAAGCCYGTAGAGGT | Vesicoureteral reflux 8 |
| 121912652 | TP53 | NM_000546.5(TP53):c.772G>A (p.Glu258Lys) | ACACTGRAAGACTCCAGGTCAGG | Li-Fraumeni syndrome 1, Hereditary cancer-predisposing syndrome |
| 587778720 | TP53 | NM_000546.5(TP53):c.638G>A (p.Arg213Gln) | CACTTTTCRACATAGTGTGTGGG | Li-Fraumeni syndrome, Li-Fraumeni syndrome 1, Hereditary cancer-predisposing syndrome, not specified |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 587781288 | TP53 | NM_000546.5(TP53):c.422 G>A (p.Cys141Tyr) | GACCTRCCCTGTGCAGCTGTGGG, AGACCTRCCCTGTGCAGCTGTGG | Hereditary cancer-predisposing syndrome |
| 1221913344 | TP53 | NM_000546.5(TP53):c.916 C>T (p.Arg306Ter) | CCCCAGGGAGCACTAAGYGAG G, CCCCAGGGAGCACTAAGYGAGG T, CCAGGGAGCACTAAGYGAGGT A, CCAGGGAGCACTAAGYGAGGTA A | Hereditary cancer-predisposing syndrome |
| 397516435 | TP53 | NM_000546.5(TP53):c.586 C>T (p.Arg196Ter) | CCCTCCTCAGCATCTTATCYGAG, CCTCCTCAGCATCTTATCYGAGT, CCTCAGCATCTTATCYGAGTGGA | Li-Fraumeni syndrome 1, Hereditary cancer-predisposing syndrome |
| 587780071 | TP53 | NM_000546.5(TP53):c.580 C>T (p.Leu194Phe) | CCCCTTCCTCCAGCATYTTATCCGA | Hereditary cancer-predisposing syndrome |
| 730882001 | TP53 | NM_000546.5(TP53):c.493 C>T (p.Gln165Ter) | CCATGGCCATCTACAAGYAGTCA | Hereditary cancer-predisposing syndrome |
| 121908841 | TP63 | NM_003722.4(TP63):c.102 8G>A (p.Arg343Gln) | GCCCRGATCTGTGCTTGCCCAGG | Ectrodactyly, ectodermal dysplasia, and cleft lip/palate syndrome 3 |
| 113993967 | TP63 | NM_003722.4(TP63):c.101 0G>A (p.Arg337Gln) | GCCRACGCTGCTTTGAGGCCCGG, CCTGGGCCRACGCTGCTTTGAGG | ADULT syndrome |
| 121964846 | TPI1 | NM_001159287.1(TPI1):c.4 78G>A (p.Gly160Arg) | CTCRGAGTAATCGCCTGCATTGG | |
| 104894503 | TPM1 | NM_001018005.1(TPM1):c.523G>A (p.Asp175Asn) | GAGCRACCTGGAACGTGCAGAG G | Primary familial hypertrophic cardiomyopathy, Familial hypertrophic cardiomyopathy 3, Sudden cardiac death, Cardiomyopathy |
| 397516382 | TPM1 | NM_001018005.1(TPM1):c.64G>A (p.Ala22Thr) | GGATCGARCTGAGCAGGCCGAG G | Cardiomyopathy, not specified |
| 199476317 | TPM1 | NM_001018005.1(TPM1):c.688G>A (p.Asp230Asn) | CCTTTCCRACAAGCTGAAGGAGG | Dilated cardiomyopathy 1Y, Cardiomyopathy, not provided |
| 199474717 | TPM3 | NM_152263.3(TPM3):c.72 1G>A (p.Glu241Lys) | TGCTRAGTTTGCTGAGAGATCGG | Congenital myopathy with fiber type disproportion, not provided |
| 199474711 | TPM3 | NM_152263.3(TPM3):c.11 C>T (p.Ala4Val) | CCACTGCTCATGATGGAGGYCAT | Congenital myopathy with fiber type disproportion, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121908195 | TPP1 | NM_000391.3(TPP1):c.229 G>A (p.Gly77Arg) | TACRGTGCCTTTTGGGACTGAGG | Ceroid lipofuscinosis, neuronal, 2 |
| 119455954 | TPP1 | NM_000391.3(TPP1):c.109 4G>A (p.Cys365Tyr) | GCCGGGTRTTGGCTGTGTCTCTGG | Ceroid lipofuscinosis, neuronal, 2, not provided |
| 119455956 | TPP1 | NM_000391.3(TPP1):c.134 0G>A (p.Arg447His) | TGGCCRTGCCTACCCAGATGTGG | Ceroid lipofuscinosis, neuronal, 2, not provided |
| 119455955 | TPP1 | NM_000391.3(TPP1):c.622 C>T (p.Arg208Ter) | CCCCTCTGTGATCCGTAAGYGAT, CCCTCTGTGATCCGTAAGYGATA, CCTCTGTGATCCGTAAGYGATAC | Ceroid lipofuscinosis, neuronal, 2, not provided |
| 28940573 | TPP1 | NM_000391.3(TPP1):c.616 C>T (p.Arg206Cys) | CCCCCTCTGTGATCYGTAAGCGA | Ceroid lipofuscinosis, neuronal, 2 |
| 104894001 | TREM2 | NM_018965.3(TREM2):c.1 32G>A (p.Trp44Ter) | ACTGRGGAGGCGCAAGGCCTG G | Polycystic lipomembranous osteodysplasia with sclerosing leukoencephalopathy |
| 121908117 | TREX1 | NM_016381.5(TREX1):c.2 17G>A (p.Asp73Asn) | TTTTTCRACATGGAGGCCACTGG | Aicardi Goutieres syndrome 1, Aicardi Goutieres syndrome 1, autosomal dominant, Chilbain lupus 1 |
| 121917847 | TRHR | NM_003301.5(TRHR):c.49 C>T (p.Arg17Ter) | CCAAACACAGCTTCAGCCAYGAG | Thyrotropin-releasing hormone resistance, generalized |
| 118204027 | TRIOBP | NM_001039141.2(TRIOBP): c.1741C>T (p.Gln581Ter) | CCCCAGAAACATCTGTGCCYAGC, CCCAGAAACATCTGTGCCYAGCG, CCAGAAACATCTGTGCCYAGCGG | Deafness, autosomal recessive 28 |
| 118204028 | TRIOBP | NM_001039141.2(TRIOBP): c.889C>T (p.Gln297Ter) | CCTCATCCACCCAYAGGAAATC | Deafness, autosomal recessive 28 |
| 118204031 | TRIOBP | NM_001039141.2(TRIOBP): c.3349C>T (p.Arg1117Ter) | CCTGTGTGTATTGGGTACYGAGA | Deafness, autosomal recessive 28 |
| 118204029 | TRIOBP | NM_001039141.2(TRIOBP): c.2362C>T (p.Arg788Ter) | CCCAATAGAGCCACAYGAGACA A, CCAATAGAGCCACAYGAGACAA C | Deafness, autosomal recessive 28 |
| 118203991 | TRMU | NM_018006.4(TRMU):c.81 5G>A (p.Gly272Asp) | TAGGTGRCCTGAGAGAGCCCTGG | Liver failure acute infantile |
| 369742878 | TRPM1 | NM_002420.5(TRPM1):c.2 998C>T (p.Arg1000Ter) | TTTCRGGGCCAGTTTCCAAGAGGG, GTTTCRGGCCAGTTTCCAAGAGG | Congenital stationary night blindness, type 1C, not provided |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 201907325 | TRPM4 | NM_017636.3(TRPM4):c.1294G>A (p.Ala432Thr) | TGGACRCCCTGCTGAATGACCGG | Progressive familial heart block type 1B |
| 267607142 | TRPM4 | NM_017636.3(TRPM4):c.19G>A (p.Glu7Lys) | GAGAAGRAGCAGGTGAGCGCCGG | Progressive familial heart block type 1B |
| 121912625 | TRPM6 | NM_017662.4(TRPM6):c.422C>T (p.Ser141Leu) | CCCAAGCTTGTGATCTYAGTCCA, CCAAGCTTGTGATCTYAGTCCAT | Hypomagnesemia 1, intestinal |
| 28939070 | TRPS1 | NM_014112.4(TRPS1):c.2894G>A (p.Arg965His) | AAGAAAGCRCCTTAACCCAGAGG | Trichorhinophalangeal dysplasia type I |
| 121908435 | TRPS1 | NM_014112.4(TRPS1):c.2762G>A (p.Arg921Gln) | TGGCRAAAGAATGCAAATGCG G, CTCTGGCRAAAGAATGCAAATGG | Trichorhinophalangeal syndrome type 3 |
| 121908432 | TRPS1 | NM_014112.4(TRPS1):c.2557C>T (p.Arg853Ter) | CCGCCCATCTGGCYGACCTATT | Trichorhinophalangeal dysplasia type I |
| 397514494 | TRPV4 | NM_021625.4(TRPV4):c.557G>A (p.Arg186Gln) | TTCRAGGTGAGCCCACCCAGATGG | Charcot-Marie-Tooth disease type 2C, Distal spinal muscular atrophy, congenital nonprogressive |
| 77975504 | TRPV4 | NM_021625.4(TRPV4):c.1781G>A (p.Arg594His) | CCCRTGGGCTGAAGCTGACGGGG, ACCCRTGGGCTGAAGCTGACGGG, CACCCRTGGGCTGAAGCTGACGG | Spondylometaphyseal dysplasia, Kozlowski type, Parastremmatic dwarfism |
| 387906905 | TRPV4 | NM_021625.4(TRPV4):c.947G>A (p.Arg316His) | ATGCGGCRCCAGGACTCGCGAGG | Charcot-Marie-Tooth disease type 2C |
| 267607143 | TRPV4 | NM_021625.4(TRPV4):c.943C>T (p.Arg315Trp) | CCACAAGAGGCGGACATGYGG C | Charcot-Marie-Tooth disease type 2C, Charcot-Marie-Tooth disease, Scapuloperoneal spinal muscular atrophy, Distal spinal muscular atrophy, congenital nonprogressive |
| 387906906 | TRPV4 | NM_021625.4(TRPV4):c.2219C>T (p.Thr740Ile) | CCCCGCAGTGGGCCACCAYCATC, CCCGCAGTGGGCCACCAYCATCC, CCGCAGTGGGCCACCAYCATCCT | Metatrophic dysplasia |
| 118203387 | TSC1 | NM_000368.4(TSC1):c.491G>A (p.Trp164Ter) | TCATRGTGCTGAAGAAAACCAGG | Tuberous sclerosis syndrome, Lymphangiomyomatosis, not provided |
| 118203427 | TSC1 | NM_000368.4(TSC1):c.682C>T (p.Arg228Ter) | CCAATGATGAGCATGTGYGAAT | Tuberous sclerosis syndrome, Tuberous sclerosis 1, not provided |
| 28934872 | TSC2 | NM_000548.3(TSC2):c.1832G>A (p.Arg611Gln) | GCATCCRGCTGCAGGTATGGTGG | Tuberous sclerosis syndrome, Lymphangiomyomatosis, Tuberous sclerosis 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 45515894 | TSC2 | NM_000548.3(TSC2):c.1322G>A (p.Trp441Ter) | CGGCTRGATTCAGAACCTGCAGG | Tuberous sclerosis syndrome, Tuberous sclerosis 2 |
| 45517150 | TSC2 | NM_000548.3(TSC2):c.976-15G>A | GCTGCCRGCCTCGTTGTTCCAGG | Tuberous sclerosis syndrome, not provided |
| 45466296 | TSC2 | NM_000548.3(TSC2):c.848+1G>A | ACAGRTGAGTGTGGTGGGTGGGG, GACAGRTGAGTGTGTGGGTGGG, GGACAGRTGAGTGTGGTGGGTGG | Tuberous sclerosis syndrome, Tuberous sclerosis 2, not provided |
| 45483392 | TSC2 | NM_000548.3(TSC2):c.5024C>T (p.Pro1675Leu) | CCACCTGATCGTCACCCGCTGG | Tuberous sclerosis syndrome, Lymphangiomyomatosis, Tuberous sclerosis 2 |
| 45517340 | TSC2 | NM_000548.3(TSC2):c.4375C>T (p.Arg1459Ter) | CCCAGTGGCCTCCGGCCCYGAGG, CCAGTGGCCTCCGGCCCYGAGGT | Tuberous sclerosis syndrome, Tuberous sclerosis 2, not provided |
| 113994153 | TSEN54 | NM_207346.2(TSEN54):c.736C>T (p.Gln246Ter) | CCCAGAGGAGAAACCCYAGGAG T, CCAGAGGAGAAACCCYAGGAGT C | Pontocerebellar hypoplasia type 4 |
| 587777688 | TSFM | NM_005726.5(TSFM):c.944G>A (p.Cys315Tyr) | TGAATRTGGAGAAGGTGAAGAG G | Combined oxidative phosphorylation deficiency 3 |
| 121918668 | TSHB | NM_000549.4(TSHB):c.145G>A (p.Gly49Arg) | TGCTRGATATTGTATGACACGGG, GTGCTRGATATTGTATGACACGG | Secondary hypothyroidism |
| 121918670 | TSHB | NM_000549.4(TSHB):c.205C>T (p.Gln69Ter) | CCCAAATATGCTCTCTGTCCYAGGA, CCAAATATGCTCTCTGTCCYAGGAT | Secondary hypothyroidism |
| 121908881 | TSHR | NM_000369.2(TSHR):c.1430C>T (p.Thr477Ile) | CCTCTGTAGACCTCTACATTCAC | Hypothyroidism, congenital, nongoitrous, 1 |
| 387907094 | TTC19 | NM_017775.3(TTC19):c.517C>T (p.Gln173Ter) | CCTTGGAGGGGGCATGAAGYAG G | Mitochondrial complex III deficiency, nuclear type 2 |
| 786205698 | TTC7A | NM_001288953.1(TTC7A):c.1474C>T (p.Gln492Ter) | CCCCACACAGGGCTCAGYAGCTG, CCCACACAGGGCTCAGYAGCTGG, CCCACACAGGGCTCAGYAGCTGGC | Multiple gastrointestinal atresias |
| 138060032 | TTN | NM_001256850.1(TTN):c.835C>T (p.Arg279Trp) | CTGCCRAGCCAGCTGCTGCTTTGG | Hereditary myopathy with early respiratory failure, not provided |
| 372277017 | TTN | NM_133378.4(TTN):c.12064C>T (p.Arg4022Ter) | GCTCRCTCAATGATTTTGGCAGG, TTCTGCTCRCTCAATGATTTTGG | Distal myopathy Markesbery-Griggs type |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397515524 | TTPA | NM_000370.3(TTPA):c.421 G>A (p.Glu141Lys) | ATCCRAGCTTATTGTACAGGAGG, CACATCCRAGCTTATTGTACAGG | Ataxia with vitamin E deficiency |
| 76992529 | TTR | NM_000371.3(TTR):c.424 G>A (p. Val142Ile) | GGCTGTCRTCACCAATCCCAAGG | Amyloidogenic transthyretin amyloidosis, Amyloid Cardiomyopathy, Transthyretin-related, Cardiomyopathy, not provided |
| 121918086 | TTR | NM_000371.3(TTR):c.241 G>A (p.Glu81Lys) | ACTRAGGAGGAATTTGTAGAAGG | Amyloidogenic transthyretin amyloidosis |
| 753719501 | TUBA1A | NM_006009.3(TUBA1A):c.1224C>A (p.Tyr408Ter) | CCCAACRTACCAGTGAACAAAGG | Lissencephaly 3 |
| 137853043 | TUBA1A | NM_006009.3(TUBA1A):c.790C>T (p.Arg264Cys) | CCTGGTGCCCTATCCCYGCATCC | Lissencephaly 3 |
| 730880027 | TUBA4A | NM_006000.2(TUBA4A):c.1220G>A (p.Trp407Ter) | GTGCACTRGTATGTGGGTGAGGG, TGTGCACTRGTATGTGGGTGAGG | Amyotrophic lateral sclerosis 22 with or without frontotemporal dementia |
| 368743618 | TUBA4A | NM_006000.2(TUBA4A):c.1147G>A (p.Ala383Thr) | CCCAGGCCTCGGCGATGYGGTC, CCAGGCCTCGGCGATGYGGTCG | Amyotrophic lateral sclerosis 22 with or without frontotemporal dementia |
| 730880025 | TUBA4A | NM_006000.2(TUBA4A):c.958C>T (p.Arg320Cys) | CCTGCTGCCTGCTYACYGTGGA | Amyotrophic lateral sclerosis 22 with or without frontotemporal dementia |
| 587777357 | TUBB | NM_178014.3(TUBB):c.1201G>A (p.Glu401Lys) | AGGCRAGGGCATGGACGAGATGG | Cortical dysplasia, complex, with other brain malformations 6 |
| 587777324 | TUBB2A | NM_001069.2(TUBB2A):c.743C>T (p.Ala248Val) | GGTCTRCGTTCAGCTGGCCCGGG, AGGTCTRCGTTCAGCTGGCCCGG | Cortical dysplasia, complex, with other brain malformations 5 |
| 398122369 | TUBB2B | NM_178012.4(TUBB2B):c.1261G>A (p.Glu421Lys) | GTCCRAGTACCAGCAGTACCAGG | Polymicrogyria, asymmetric |
| 267607163 | TUBB3 | NM_001197181.1(TUBB3):c.688G>A (p.Ala230Thr) | GCCRCCTGCGACCCCGCCACGG | Fibrosis of extraocular muscles, congenital, 3a, with or without extraocular involvement |
| 483352809 | TUBB4A | NM_006087.3(TUBB4A):c.745G>A (p.Asp249Asn) | GAACGCCRACCTGCGCAAGCTGG | Leukodystrophy, hypomyelinating, 6 |
| 587777074 | TUBB4A | NM_001289123.1(TUBB4A):c.964G>A (p.Ala322Thr) | CCCCGGCTGGTCAGGGGTGYGAA, CCCGGCTGGTCAGGGGTGYGAAG, CCGGCTGGTCAGGGGTGYGAAGC | Autosomal dominant torsion dystonia 4 |
| 121434452 | TUFM | NM_003321.4(TUFM):c.1016G>A (p.Arg339Gln) | CTTGCGGCRGGGCCTGGTCATGG | Combined oxidative phosphorylation deficiency 4 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121909077 | TULP1 | NM_003322.4(TULP1):c.1444C>T (p.Arg482Trp) | CCCTCAACTTCCAAGGCYGGGTC, CCCTCAACTTCCAAGGCYGGGTCA | Retinitis pigmentosa 14 |
| 121909190 | TWIST1 | NM_000474.3(TWIST1):c.556G>A (p.Ala186Thr) | GCTACRCCTTCTCGGTCTGAAGG, TCAGCTACRCCTTCTCGGTCTGG | Craniosynostosis 1 |
| 104894065 | TWIST1 | NM_000474.3(TWIST1):c.211C>T (p.Gln71Ter) | CCGGGCAGCCCGGCCYAGGGCAA | Robinow Sorauf syndrome |
| 387906974 | TWIST2 | NM_057179.2(TWIST2):c.193C>T (p.Gln65Ter) | CCCTTCGAGGAGCTGYAGAGCCAG | Congenital ectodermal dysplasia of face |
| 727502794 | TXNL4A | NM_001305563.1(TXNL4A):c.-60-10655C>T | CCCTGCACAACGGCTGGYAGGTGG | Burn-Mckeown syndrome |
| 121913037 | TYMP | NM_001113755.2(TYMP):c.433G>A (p.Gly145Arg) | TGATCAGCRGACGTGGTCTGGGG | |
| 121913038 | TYMP | NM_001113755.2(TYMP):c.457G>A (p.Gly153Ser) | AGGARGCACCTTGGATAAGCTGG | |
| 28940880 | TYR | NM_000372.4(TYR):c.616G>A (p.Ala206Thr) | AAGCACCARCTTTTCTGCCTTGG | Tyrosinase-negative oculocutaneous albinism, not provided |
| 61753180 | TYR | NM_000372.4(TYR):c.140G>A (p.Gly47Asp) | TGTGRCCAGCTTTCAGGCAGAGG | Tyrosinase-negative oculocutaneous albinism, Oculocutaneous albinism type 1B, not provided |
| 137854890 | TYR | NM_000372.4(TYR):c.272G>A (p.Cys91Tyr) | CAGTRCTCTGGCAACTTCATGGG, CCAGTRCTCTGGCAACTTCATGG | Tyrosinase-negative oculocutaneous albinism |
| 28940876 | TYR | NM_000372.4(TYR):c.242C>T (p.Pro81Leu) | CCGGGAGTCCTGGCYTTCCGTCT | Tyrosinase-negative oculocutaneous albinism, Oculocutaneous albinism type 1B, not provided |
| 61753178 | TYR | NM_000372.4(TYR):c.61C>T (p.Pro21Ser) | CCCTCCGCTGGCCATTTCYCTAGA, CCGCTGGCCATTTCYCTAGAGCC | Tyrosinase-negative oculocutaneous albinism, not provided |
| 104894313 | TYR | NM_000372.4(TYR):c.1217C>T (p.Pro406Leu) | CCGAAGGCACCGTCYTCTTCAAG | Oculocutaneous albinism type 1B, not provided |
| 80356547 | UBA1 | NM_003334.3(UBA1):c.1731C>T (p.Asn577=) | CCAATGCCCTGGACAAYGTGGAT | Arthrogryposis multiplex congenita, distal, X-linked |
| 387906710 | UBQLN2 | NM_013444.3(UBQLN2):c.1489C>T (p.Pro497Ser) | CCCTGTAGGCCCAGTCACCYCCA, CCTGTAGGCCCAGTCACCYCCAT | Amyotrophic lateral sclerosis 15, with or without frontotemporal dementia |
| 387906712 | UBQLN2 | NM_013444.3(UBQLN2):c.1525C>T (p.Pro509Ser) | CCCTATAGTCCCTTTACCYCCA, CCTATAGTCCCTTTACCYCCAT | Amyotrophic lateral sclerosis 15, with or without frontotemporal dementia |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 17848368 | UCP3 | NM_003356.3(UCP3):c.208 C>T (p.Arg70Trp) | CCATCCTGACCATGGTGYGGACT | Familial juvenile gout |
| 28934582 | UMOD | NM_003361.3(UMOD):c.4 43G>A (p.Cys148Tyr) | TGGCACTRTGAGTGCTCCCCGGG, ATGGCACTRTGAGTGCTCCCCGG | not provided |
| 398123698 | UMOD | NM_003361.3(UMOD):c.9 44G>A (p.Cys315Tyr) | ATGGCACTRCCAGTGCAAACAGG | not provided |
| 777759523 | UNC13D | NM_199242.2(UNC13D):c.1389+1G>A | CCCCAGCGCGAGTACCATAYCTG, CCCAGCGCGAGTACCATAYCTGC, CCAGCGCGAGTACCATAYCTGCA | Hemophagocytic lymphohistiocytosis, familial, 3 |
| 11544803 | UQCRQ | NM_014402.4(UQCRQ):c.1 34C>T (p.Ser45Phe) | CCGCATTCGGGAGTYTTTCTTTC | Mitochondrial complex III deficiency, nuclear type 4 |
| 137852795 | UROC1 | NM_001165974.1(UROC1): c.1528C>T (p.Arg510Cys) | CCAGGGATTTGGGCCTTTCYGCT | Urocanate hydratase deficiency |
| 121918066 | UROD | NM_000374.4(UROD):c.99 5G>A (p.Arg332His) | CATCRCTACATTGCCAACCTGGG, ACATCRCTACATTGCCAACCTGG | Familial porphyria cutanea tarda |
| 397514765 | UROD | NM_000374.4(UROD):c.34 6C>T (p.Gln116Ter) | CCATTAAGAGAAGAGYAGGACCT | Porphyria cutanea tarda |
| 121918064 | UROD | NM_000374.4(UROD):c.58 3C>T (p.Leu195Phe) | CCAGCTGCTTCGCATCYTCACTG | Familial porphyria cutanea tarda |
| 397515349 | UROS | NM_000375.2(UROS):c.-26-183G>A | CTTGRCCTTATCAGTGACAGGGG, TCTTGRCCTTATCAGTGACAGGG, TTCTTGRCCTTATCAGTGACAGG | Congenital erythropoietic porphyria |
| 121908014 | UROS | NM_000375.2(UROS):c.68 3C>T (p.Thr228Met) | CCATCGGCCCCACTAYGGCTCGC | Congenital erythropoietic porphyria |
| 121908015 | UROS | NM_000375.2(UROS):c.10 C>T (p.Leu4Phe) | CCAGGCAATAATGAAGGTTYTTT | Congenital erythropoietic porphyria |
| 104894652 | USH1G | NM_173477.4(USH1G):c.1 13G>A (p.Trp38Ter) | ACTCTCTRGGCTGCCTACCATGG | Usher syndrome, type 1G |
| 397517974 | USH2A | NM_206933.2(USH2A):c.1 143+1G>A | TCAGRTAATGAGAAACGATAAGG | Usher syndrome, type 2A |
| 111033386 | USH2A | NM_206933.2(USH2A):c.6 224G>A (p.Trp2075Ter) | CTCCTRGACCCCACCCAAAAAGG | Usher syndrome, type 2A |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 121912599 | USH2A | NM_206933.2(USH2A):c.956G>A (p.Cys319Tyr) | TACTRCATTCCTAATGATGCAGG | Usher syndrome, type 2A |
| 146733615 | USH2A | NM_206933.2(USH2A):c.14803C>T (p.Arg4935Ter) | CTCRGTACTGAGGCACTGTGGGG, GCTCRGTACTGAGGCACTGTGGG, GGCTCRGTACTGAGGCACTGTGG | Usher syndrome, type 2A, Retinitis pigmentosa 39 |
| 397517983 | USH2A | NM_206933.2(USH2A):c.12868C>T (p.Gln4290Ter) | CCTGATCCCACCAGAAYAGTCT | Usher syndrome, type 2A |
| 199605265 | USH2A | NM_206933.2(USH2A):c.12575G>A (p.Arg4192His) | CCCTCGAAGCATCTGYGAATCAC, CCTCGAAGCATCTGYGAATCACT | Retinitis pigmentosa 39, not specified |
| 727504867 | USH2A | NM_206933.2(USH2A):c.14248C>T (p.Gln4750Ter) | CCATGTGATCTCTTTCTACCYAAG | Usher syndrome, type 2A |
| 121918218 | VANGL1 | NM_138959.2(VANGL1):c.715G>A (p.Val239Ile) | CCATCRTCCTGCTGGAGCTCAGG | Caudal regression syndrome |
| 121909791 | VDR | NM_001017535.1(VDR):c.218G>A (p.Arg73Gln) | GGACAACCRACGCCACTGCCAGG | Vitamin D-dependent rickets, type 2 |
| 121909793 | VDR | NM_001017535.1(VDR):c.239G>A (p.Arg80Gln) | CTGCCRGCTCAAACGCTGTGTGG | Vitamin D-dependent rickets, type 2 |
| 121909794 | VDR | NM_001017535.1(VDR):c.149G>A (p.Arg50Gln) | CAGGCRAAGCATGAAGCGGAAGG | Vitamin D-dependent rickets, type 2 |
| 121909802 | VDR | NM_001017535.1(VDR):c.985G>A (p.Glu329Lys) | GGAGRAGACATGTCCTGCTCATGG | Vitamin D-dependent rickets, type 2 |
| 121909795 | VDR | NM_001017535.1(VDR):c.454C>T (p.Gln152Ter) | CCTACTCCGACTTCTGCYAGTTC | Vitamin D-dependent rickets, type 2 |
| 121909800 | VDR | NM_001017535.1(VDR):c.1171C>T (p.Arg391Cys) | CCAGAAGCTAGCCGACCTGYGCA | Vitamin D-dependent rickets, type 2 |
| 587777567 | VEGFC | NM_005429.4(VEGFC):c.628C>T (p.Arg210Ter) | GCATCRGCAGGAAGTGTGATTGG | Lymphedema, hereditary, id |
| 730882035 | VHL | NM_000551.3(VHL):c.482G>A (p.Arg161Gln) | AGCRATGCCTCCAGGTTGTCCGG | Hereditary cancer-predisposing syndrome |
| 730882034 | VHL | NM_000551.3(VHL):c.257C>T (p.Pro86Leu) | CCGCGCGTCGTGCYCGTATG | Hereditary cancer-predisposing syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 200370925 | VIPAS39 | NM_022067.3(VIPAS39):c.658C>T (p.Arg220Ter) | CCTGTCRCACCTCCAGCTCTCGG | Arthrogryposis, renal dysfunction, and cholestasis 2 |
| 180177366 | VPS13B | NM_017890.4(VPS13B):c.6732+1G>A | TACTACAGRTCTGTGTGGGTATTGG | Cohen syndrome, not provided |
| 180177356 | VPS13B | NM_017890.4(VPS13B):c.2074C>T (p.Arg692Ter) | CCTTTGCCATCCATTYGAATATT | Cohen syndrome, not provided |
| 180177370 | VPS13B | NM_017890.4(VPS13B):c.8318C>T (p.Ser2773Leu) | CCAAACAGAAATTGCCTTYGTAC | not provided |
| 121434383 | VPS33B | NM_018668.4(VPS33B):c.1594C>T (p.Arg532Ter) | CCCAGGTGCTAGAGCGGYGAAG C, CCAGGTGCTAGAGCGGYGAAGCT | Arthrogryposis renal dysfunction cholestasis syndrome |
| 61749398 | VWF | NM_000552.3(VWF):c.3970G>A (p.Gly1324Ser) | GACRGCTCCCACGCCTACATCGG | von Willebrand disease type 2M, not provided |
| 61749380 | VWF | NM_000552.3(VWF):c.3854C>T (p.Ser1285Phe) | CCTGCTGGATGGCTYCTCCAGGC | von Willebrand disease type 2M, not provided |
| 61751296 | VWF | NM_000552.3(VWF):c.7603C>T (p.Arg2535Ter) | CCTCATCAATGAGTGTGTCYGAG | von Willebrand disease type 3, not provided |
| 132630273 | WAS | NM_000377.2(WAS):c.134C>T (p.Thr45Met) | CCTGCTTTCCTCTCCAGAYGCT | Thrombocytopenia, X-linked |
| 200322968 | WDPCP | NM_015910.5(WDPCP):c.160G>A (p.Asp54Asn) | CCAGAGCTCATTTACYCGCAATG | Orstavik Lindemann Solberg syndrome |
| 587777351 | WDR19 | NM_025132.3(WDR19):c.3703G>A (p.Glu1235Lys) | GATCRAGGGAATGGTCAGGTAGG, AGAAGATCRAGGGAATGGTCAG G | Nephronophthisis 13 |
| 587777350 | WDR19 | NM_025132.3(WDR19):c.682C>T (p.Gln228Ter) | CCCAGCTGATCTTGAATTTYAGC, CCAGCTGATCTTGAATTTYAGCA | Nephronophthisis 13 |
| 587777097 | WDR34 | NM_052844.3(WDR34):c.472C>T (p.Gln158Ter) | CTTRGGCTGGCGGGTAGCCCAGG | Short-rib thoracic dysplasia 11 with or without polydactyly |
| 116529882 | WDR36 | NM_139281.2(WDR36):c.1586G>A (p.Arg529Gln) | ACATCRAGGAAGTTTTGGCAAGG | Glaucoma 1, open angle, G |
| 587784553 | WDR62 | NM_001083961.1(WDR62):c.332+1G>A | CGCCAGRTAGGCTGAGGCCTGGG, CCGCCAGRTAGGCTGAGGCCTGG | Primary autosomal recessive microcephaly 2 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 387907082 | WDR62 | NM_001083961.1(WDR62): c.1313G>A (p.Arg438His) | CACCATTCRCTTCTGGAACTTGG | Primary autosomal recessive microcephaly 2 |
| 754099015 | WDR73 | NM_032856.3(WDR73):c.1 039C>T (p.His347Tyr) | CAGTGTRGGTGGTGACCAAAGG | Microcephaly, hiatal hernia and nephrotic syndrome |
| 587776906 | WDR81 | NM_001163809.1(WDR81): c.2567C>T (p.Pro856Leu) | CCTGTCTCCCAGGGCCTGCYCCC | Cerebellar ataxia, mental retardation, and dysequilibrium syndrome 2 |
| 28937895 | WFS1 | NM_006005.3(WFS1):c.24 92G>A (p.Gly831Asp) | AGGRCCGCTGGGCAGCAAGTGG | WFS1-Related Disorders |
| 387906931 | WFS1 | NM_006005.3(WFS1):c.23 38G>A (p.Gly780Ser) | GTGRGCATGCCATTCAGCAGCGG | Wolfram-like syndrome, autosomal dominant |
| 104893880 | WFS1 | NM_006005.3(WFS1):c.67 6C>T (p.Gln226Ter) | CCCAAGTCCCTGCAGAAGYAGAG, CCAAGTCCCTGCAGAAGYAGAGG | Diabetes mellitus AND insipidus with optic atrophy AND deafness |
| 28937890 | WFS1 | NM_006005.3(WFS1):c.21 71C>T (p.Pro724Leu) | CCATCAACATGCTCCYGTTCTTC | Diabetes mellitus AND insipidus with optic atrophy AND deafness |
| 28937892 | WFS1 | NM_006005.3(WFS1):c.15 11C>T (p.Pro504Leu) | CCTCAACGTCAGCGTTCCYGTGCC | Diabetes mellitus AND insipidus with optic atrophy AND deafness |
| 121908899 | WISP3 | NM_003880.3(WISP3):c.43 4G>A (p.Cys145Tyr) | CTCTRTGTGAGTGGGGCCATTGG | Progressive pseudorheumatoid dysplasia |
| 111033591 | WNK1 | NM_213655.4(WNK1):c.32 26C>T (p.Arg1076Ter) | CCTTCAGCGTGTTTACYGAAATCG | |
| 111033592 | WNK1 | NM_213655.4(WNK1):c.25 75C>T (p.Gln859Ter) | CCCAAACTCACCACTTCYAACCC, CCAAACTCACCACTTCYAACCCC | |
| 146902156 | WNT10A | NM_025216.2(WNT10A):c. 649G>A (p.Asp217Asn) | CAGCCCCRACATGGGCTTCCGGG, GCAGCCCCRACATGGGCTTCGGG | Tooth agenesis, selective, 4, not provided |
| 147680216 | WNT10A | NM_025216.2(WNT10A):c. 637G>A (p.Gly213Ser) | GGCRGCTGCAGCCCCGACATGG, GGGCRGCTGCAGCCCCGACATGG | Tooth agenesis, selective, 4 |
| 104894653 | WNT3 | NM_030753.4(WNT3):c.24 7C>T (p.Gln83Ter) | CCAGGAGTGCCAGCACYAGTTCC | Tetraamelia, autosomal recessive |
| 786204837 | WNT5A | NM_003392.4(WNT5A):c.2 06G>A (p.Cys69Tyr) | CCTCTCTRCAGCCAACTGGCAGG | Robinow syndrome |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 104893832 | WNT7A | NM_004625.3(WNT7A):c.325G>A (p.Ala109Thr) | ACCTACRCCATCATTGCCGCCGG | Fuhrmann syndrome |
| 397514643 | WNT7A | NM_004625.3(WNT7A):c.664C>T (p.Arg222Trp) | CCACACTGCCACAGTTTYGGGAG | Ulna and fibula absence of with severe limb deficiency |
| 281865550 | WRAP53 | NM_018081.2(WRAP53):c.1303G>A (p.Gly435Arg) | GAGCRGGGCTGTCTCTGTGTGGG, CGAGCRGGGCTGTCTCTGTGTGG | Dyskeratosis congenita, autosomal recessive, 3 |
| 281865548 | WRAP53 | NM_018081.2(WRAP53):c.1192C>T (p.Arg398Trp) | CCTGTGCTGGGATCTCYGGCAGT | Dyskeratosis congenita, autosomal recessive, 3 |
| 281865549 | WRAP53 | NM_018081.2(WRAP53):c.1126C>T (p.His376Tyr) | CCCACCTCTGCTTTYATCCCGAT | Dyskeratosis congenita, autosomal recessive, 3 |
| 121908446 | WRN | NM_000553.4(WRN):c.3913C>T (p.Arg1305Ter) | CCCCCTTGATTTGGAGYGAGCAG, CCCCTTGATTTGGAGYGAGCAGG, CCCTTGATTTGGAGYGAGCAGGC | Werner syndrome |
| 121907909 | WT1 | NM_024426.4(WT1):c.1372C>T (p.Arg458Ter) | CCAGTGTAAAACTTGTCAGYGAA | Frasier syndrome, Wilms tumor 1 |
| 72549369 | XDH | NM_000379.3(XDH):c.445C>T (p.Arg149Cys) | CCCACAGGAAATCTGTCGYGCTG, CCACAGGAAATCTGTCGYGCTGC | Deficiency of xanthine oxidase |
| 104894953 | XK | NM_021083.2(XK):c.941G>A (p.Trp314Ter) | CCATAATTRGTACCAGCTACTGG | McLeod neuroacanthocytosis syndrome |
| 201818754 | XYLT1 | NM_022166.3(XYLT1):c.1588-3C>T | GAAGGACTRCAGGGGAGAGAGG | Desbuquois dysplasia 2 |
| 587777367 | XYLT1 | NM_022166.3(XYLT1):c.1792C>T (p.Arg598Cys) | TGCRGGCAAAGAAGGTAGGCCG, AACTTGCRGGCAAAGAAGGTAG | Desbuquois dysplasia 2 |
| 587777368 | XYLT1 | NM_022166.3(XYLT1):c.439C>T (p.Arg147Ter) | TCTGTTCRCACTTTCTCTTTCGG | Desbuquois dysplasia 2 |
| 587777249 | YAP1 | NM_001130145.2(YAP1):c.370C>T (p.Arg124Ter) | CCTGACTCCACAGCATGTTYGAG | Congenital ocular coloboma |
| 121908833 | YARS | NM_003680.3(YARS):c.121G>A (p.Gly41Arg) | TACTGGRGAACGGCAACCACGGG, TTACTGGRGAACGGCAACCACGG | Charcot-Marie-Tooth disease, dominant intermediate C |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 113994173 | ZAP70 | NM_001079.3(ZAP70):c.83 7+121G>A | CTGTCTCTRGGAGTCCTCAGTGG | Severe combined immunodeficiency, atypical |
| 137853201 | ZAP70 | NM_001079.3(ZAP70):c.13 94G>A (p.Arg465His) | GGCGCCCRCAACGTCCTGCTGG | Severe combined immunodeficiency, atypical |
| 113994174 | ZAP70 | NM_001079.3(ZAP70):c.13 93C>T (p.Arg465Cys) | CCGTGACTCGGCGGCCYGCAACG | Severe combined immunodeficiency, atypical |
| 483353070 | ZBTB20 | NM_001164342.2(ZBTB20): c.1861C>T (p.Leu621Phe) | CCTTAAAGGATTACYTTATCAAG | Primrose syndrome |
| 387907106 | ZBTB24 | NM_014797.2(ZBTB24):c. 1369C>T (p.Arg457Ter) | CCCACATCAGAATCCATYGGTAA, CCACATCAGAATCCATYGGTAAA | Immunodeficiency-centromeric instability-facial anomalies syndrome 2 |
| 730882163 | ZBTB42 | NM_001137601.2(ZBTB42): c.1190G>A (p.Arg397His) | AGCRCCGTTTCACGCAGTCCGG, GAGCRCCGTTTCACGCAGTCCGG | Lethal congenital contracture syndrome 6 |
| 587784563 | ZEB2 | NM_014795.3(ZEB2):c.195 6C>T (p.Tyr652=) | CCCCATCAACCCATAYAAGGACC, CCCCATCAACCCATAYAAGGACCA | Mowat-Wilson syndrome |
| 587784566 | ZEB2 | NM_014795.3(ZEB2):c.276 1C>T (p.Arg921Ter) | CCAGTATTCCTGGGCTAYGACCA | Mowat-Wilson syndrome |
| 587784571 | ZEB2 | NM_014795.3(ZEB2):c.904 C>T (p.Arg302Ter) | CCATCTGAAAGAACACCTGYGAA | Mowat-Wilson syndrome, not provided |
| 387907057 | ZFYVE26 | NM_015346.3(ZFYVE26):c. 5422C>T (p.Gln1808Ter) | CCCCCTGCCAGGCACYAGTGGGT, CCCCTGCCAGGCACYAGTGGGTA | Spastic paraplegia 15 |
| 122462165 | ZIC3 | NM_003413.3(ZIC3):c.968 C>T (p.Thr323Met) | CCACATCCGAGTGCACAYGGGCG | Heterotaxy, visceral, X-linked |
| 281875376 | ZMPSTE 24 | NM_005857.4(ZMPSTE24): c.1349G>A (p.Trp450Ter) | CTGACTRGTTGTTCTCAATGTGG | Mandibuloacral dysplasia with type B lipodystrophy, not provided |
| 121908094 | ZMPSTE 24 | NM_005857.4(ZMPSTE24): c.121C>T (p.Gln41Ter) | CCTTCCTAGCACAGCGGYAGGTG | Mandibuloacral dysplasia with type B lipodystrophy, not provided |
| 397515460 | ZMYND1 0 | NM_015896.3(ZMYND10): c.967C>T (p.Gln323Ter) | CCCTAACTGAAACCYAGCCTCCT | Ciliary dyskinesia, primary, 22 |
| 672601340 | ZMYND1 1 | NM_006624.5(ZMYND11): c.976C>T | CCTTCTGAAAACATTYAAGATAT | Mental retardation, autosomal dominant 30 |

TABLE 2-continued

Target mutations that may be corrected using nucleobase editors, including exemplary gRNA sequences. gRNA sequences in the table correspond to SEQ ID NOs: 740-5526 from top to bottom.

| RS# (dbSNP) | Gene Symbol | Name | gRNAall | Phenotypes |
|---|---|---|---|---|
| 397514642 | ZNF335 | NM_022095.3(ZNF335):c.3 332G>A (p.Arg1111His) | GCAGCRGTGAGGCCAGATACTGG | Primary autosomal recessive microcephaly 10 |
| 781192528 | ZNF408 | NM_024741.2(ZNF408):c.1 621C>T (p.Arg541Cys) | CCAGCTGCCTGAACTGCGGYGCC | RETINITIS PIGMENTOSA 72 |
| 373273223 | ZNF408 | NM_024741.2(ZNF408):c.1 363C>T (p.His455Tyr) | CCGGCCCCTCCTGCGGCTGYATC, CCCTCCCTGCGGCTGYATCGCAA, CCTCCCTGCCGGCTGYATCGCAAG | Exudative vitreoretinopathy 6 |
| 273585629 | ZNF469 | NM_001127464.2(ZNF469): c.11101G>A (p.Gly3701Ser) | AAACCCRGCCCCAGCTCCCAGGG, CAAACCCRGCCCCAGCTCCCAGG | Keratoconus 1 |
| 387907062 | ZNF469 | NM_001127464.2(ZNF469): c.10016G>A (p.Cys3339Tyr) | CCTGTRCCCCGGTGCCCCCGGG, ACCTGTRCCCCGGTGCCCCCGG | Corneal fragility keratoglobus, blue sclerae AND joint hypermobility |
| 273585617 | ZNF469 | NM_001127464.2(ZNF469): c.290C>T (p.Pro97Leu) | CCCCCAGACCCCACYGGGGAGA A | Keratoconus 1 |
| 273585630 | ZNF469 | NM_001127464.2(ZNF469): c.11615C>T (p.Pro3872Leu) | CCTTCCCCAGGGAGACYCCTG, CCCCCAGGGGAGACYCCTGCTCA | Keratoconus 1 |

In some embodiments, a fusion protein recognizes canonical PAMs and therefore can correct the pathogenic G to A or C to T mutations with canonical PAMs, e.g., NGG, respectively, in the flanking sequences. For example, Cas9 proteins that recognize canonical PAMs comprise an amino acid sequence that is at least 80%, 85%, 90%, 95%, 97%, 98%, or 99% identical to the amino acid sequence of *Streptococcus pyogenes* Cas9 as provided by SEQ ID NO: 52, or to a fragment thereof comprising the RuvC and HNH domains of SEQ ID NO: 52.

It will be apparent to those of skill in the art that in order to target any of the fusion proteins comprising a Cas9 domain and an adenosine deaminase, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:nucleic acid editing enzyme/domain fusion protein. In some embodiments, the guide RNA comprises a structure 5'-[guide sequence]-guuuuagagcua-gaaauagcaaguuaaaauaaaggcuaguccguuaucaac-uugaaaaaguggcaccgagucggugcuu uuu-3' (SEQ ID NO: 389), wherein the guide sequence comprises a sequence that is complementary to the target sequence. In some embodiments, the guide sequence comprises any of the nucleotide sequences provided in Table 2 The guide sequence is typically 20 nucleotides long. The sequences of suitable guide RNAs for targeting Cas9:nucleic acid editing enzyme/domain fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein. Additional guide sequences are shown below in Table 3, including their locus.

TABLE 3

Additional target sites.

| locus | 5 to 3' |
|---|---|
| other sites within HEK2 locus | GAACACAAAGCATAGACTGC (SEQ ID NO: 390) |
| other sites within HEK2 locus | GGAACACAAAGCATAGACTG (SEQ ID NO: 391) |
| other sites within HEK2 locus | AACACAAAGCATAGACTGCG (SEQ ID NO: 392) |
| other sites within HEK2 locus | ACAAAGCATAGACTGCGGGG (SEQ ID NO: 393) |
| other sites within HEK2 locus | CAAAGCATAGACTGCGGGGC (SEQ ID NO: 394) |
| other sites within HEK2 locus | GTGGTAATTTTCCAGCCCGC (SEQ ID NO: 395) |
| other sites within HEK2 locus | CCTTTACAGGGCCAGCGGGC (SEQ ID NO: 396) |
| other sites within HEK2 locus | CTGTCACAGTTAGCTCAGCC (SEQ ID NO: 397) |

TABLE 3-continued

Additional target sites.

| locus | 5 to 3' |
|---|---|
| other sites within HEK2 locus | GTGTTCCAGTTTCCTTTACA (SEQ ID NO: 398) |
| Hek-2 guideSEQ off-target | GAACACAATGCATAGATTGC (SEQ ID NO: 399) |
| Hek-2 similar site | GAAAAAAAGCAGAGACTGC (SEQ ID NO: 400) |
| Hek-2 similar site | GAATACTAAGCATAGACTCC (SEQ ID NO: 401) |
| Hek-2 similar site | GTAAACAAAGCATAGACTGA (SEQ ID NO: 402) |
| Hek-2 similar site | GGACACAAAGCTTAGACTCC (SEQ ID NO: 403) |
| Hek-2 similar site | CAATACAAAGGATAGACTGC (SEQ ID NO: 404) |
| Hek-2 similar site | GAAGACCAAGGATAGACTGC (SEQ ID NO: 405) |
| Hek-2 similar site | GAAAACAAATCATTGACTGC (SEQ ID NO: 406) |
| Hek-2 similar site | GATCACAAAGCATGGACTGA (SEQ ID NO: 407) |
| Hek-2 similar site | GAAAACAAAACATAGAGTGC (SEQ ID NO: 408) |
| Hek-2 similar site | GAACATAAAGAATAGAATGA (SEQ ID NO: 409) |
| EMX1 | GAGTCCGAGCAGAAGAAGAA (SEQ ID NO: 410) |
| FANCF: | GGAATCCCTTCTGCAGCACC (SEQ ID NO: 411) |
| HEK293 site 2: | GAACACAAAGCATAGACTGC (SEQ ID NO: 412) |
| HEK293 site 3: | GGCCCAGACTGAGCACGTGA (SEQ ID NO: 413) |
| HEK293 site 4: | GGCACTGCGGCTGGAGGTCC (SEQ ID NO: 414) |
| RNF2: | GTCATCTTAGTCATTACCTG (SEQ ID NO: 415) |

Base Editor Efficiency

Some aspects of the disclosure are based on the recognition that any of the base editors provided herein are capable of modifying a specific nucleotide base without generating a significant proportion of indels. An "indel", as used herein, refers to the insertion or deletion of a nucleotide base within a nucleic acid. Such insertions or deletions can lead to frame shift mutations within a coding region of a gene. In some embodiments, it is desirable to generate base editors that efficiently modify (e.g. mutate or deaminate) a specific nucleotide within a nucleic acid, without generating a large number of insertions or deletions (i.e., indels) in the nucleic acid. In certain embodiments, any of the base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. in some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the base editors provided herein are capable of limiting formation of indels in a region of a nucleic acid. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to a base editor.

Some aspects of the disclosure are based on the recognition that any of the base editors provided herein are capable of efficiently generating an intended mutation, such as a point mutation, in a nucleic acid (e.g. a nucleic acid within a genome of a subject) without generating a significant number of unintended mutations, such as unintended point mutations. In some embodiments, a intended mutation is a mutation that is generated by a specific base editor bound to a gRNA, specifically designed to generate the intended mutation. In some embodiments, the intended mutation is a mutation associated with a disease or disorder. In some embodiments, the intended mutation is a adenine (A) to guanine (G) point mutation associated with a disease or disorder. In some embodiments, the intended mutation is a thymine (T) to cytosine (C) point mutation associated with a disease or disorder. In some embodiments, the intended mutation is a adenine (A) to guanine (G) point mutation within the coding region of a gene. In some embodiments, the intended mutation is a thymine (T) to cytosine (C) point mutation within the coding region of a gene. In some embodiments, the intended mutation is a point mutation that generates a stop codon, for example, a premature stop codon within the coding region of a gene. In some embodiments, the intended mutation is a mutation that eliminates a stop codon. In some embodiments, the intended mutation is a mutation that alters the splicing of a gene. In some embodiments, the intended mutation is a mutation that alters the regulatory sequence of a gene (e.g., a gene promotor or gene repressor). In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. It should be appreciated that the characteristics of the base editors described in the "Base Editor Efficiency" section, herein, may be applied to any of the fusion proteins, or methods of using the fusion proteins provided herein.

Methods for Editing Nucleic Acids

Some aspects of the disclosure provide methods for editing a nucleic acid. In some embodiments, the method is a method for editing a nucleobase of a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to an adenosine deaminase) and a guide nucleic acid (e.g., gRNA), wherein the target region comprises a targeted nucleobase pair, b) inducing strand separation of said target region, c) converting a first nucleobase of said target nucleobase pair in a single strand of the target region to a second nucleobase, and d) cutting no more than one strand of said target region, where a third nucleobase complementary to the first nucleobase base is replaced by a fourth nucleobase complementary to the second nucleobase. In some embodiments, the method results in less than 20% indel formation in the nucleic acid. It should be appreciated that in some embodiments, step b is omitted. In some embodiments, the first nucleobase is an adenine. In some embodiments, the second nucleobase is a deaminated adenine, or inosine. In some embodiments, the third nucleobase is a thymine. In some embodiments, the fourth nucleobase is a cytosine. In some embodiments, the method results in less than 19%, 18%, 16%, 14%, 12%, 10%, 8%, 6%, 4%, 2%, 1%, 0.5%, 0.2%, or less than 0.1% indel formation. In some embodiments, the method further comprises replacing the second nucleobase with a fifth nucleobase that is complementary to the fourth nucleobase, thereby generating an intended edited base pair (e.g., A:T to G:C). In some embodiments, the fifth nucleobase is a guanine. In some embodiments, at least 5% of the intended base pairs are edited. In some embodiments, at least 10%, 15%, 20%, 25%, 30%, 35%, 40%, 45%, or 50% of the intended base paires are edited.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand (nicked strand) is hybridized to the guide nucleic acid. In some embodiments, the cut single strand is opposite to the strand comprising the first nucleobase. In some embodiments, the base editor comprises a Cas9 domain. In some embodiments, the first base is adenine, and the second base is not a G, C, A, or T. In some embodiments, the second base is inosine. In some embodiments, the first base is adenine. In some embodiments, the second base is not a G, C, A, or T. In some embodiments, the second base is inosine. In some embodiments, the base editor inhibits base excision repair of the edited strand. In some embodiments, the base editor protects or binds the non-edited strand. In some embodiments, the base editor comprises UGI activity. In some embodiments, the base editor comprises a catalytically inactive inosine-specific nuclease. In some embodiments, the base editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the base editors provided herein. In some embodiments, a target window is a deamination window.

In some embodiments, the disclosure provides methods for editing a nucleotide. In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair, b) inducing strand separation of said target region, c) converting a first nucleobase of said target nucleobase pair in a single strand of the target region to a second nucleobase, d) cutting no more than one strand of said target region, wherein a third nucleobase complementary to the first nucleobase base is replaced by a fourth nucleobase complementary to the second nucleobase, and the second nucleobase is replaced with a fifth nucleobase that is complementary to the fourth nucleobase, thereby generating an intended edited base pair, wherein the efficiency of generating the intended edited base pair is at least 5%. It should be appreciated that in some embodiments, step b is omitted. In some embodiments, at least 5% of the intended base pairs are edited. In some embodiments, at least 10%, 15%, 20%, 25%, 30%, 35%, 40%, 45%, or 50% of the intended base pairs are edited. In some embodiments, the method causes less than 19%, 18%, 16%, 14%, 12%, 10%, 8%, 6%, 4%, 2%, 1%, 0.5%, 0.2%, or less than 0.1% indel formation. In some embodiments, the ratio of intended product to unintended products at the target nucleotide is at least 2:1, 5:1, 10:1, 20:1, 30:1, 40:1, 50:1, 60:1, 70:1, 80:1, 90:1, 100:1, or 200:1, or more. In some embodiments, the ratio of intended point mutation to indel formation is greater than 1:1, 10:1, 50:1, 100:1, 500:1, or 1000:1, or more. In some embodiments, the cut single strand is hybridized to the guide nucleic acid. In some embodiments, the cut single strand is opposite to the strand comprising the first nucleobase. In some embodiments, the first base is adenine. In some embodiments, the second nucleobase is not G, C, A, or T. In some embodiments, the second base is inosine. In some embodiments, the base editor inhibits base excision repair of the edited strand. In some embodiments, the base editor protects (e.g., form base excision repair) or binds the non-edited strand. In some embodiments, the nucleobase editor comprises UGI activity. In some embodiments, the base editor comprises a catalytically inactive inosine-specific nuclease. In some embodiments, the nucleobase editor comprises nickase activity. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the nucleobase editor comprises a linker. In some embodiments, the linker is 1-25 amino acids in length. In some embodiments, the linker is 5-20 amino acids in length. In some embodiments, the linker is 10, 11, 12, 13, 14, 15, 16, 17, 18, 19, or 20 amino acids in length. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair occurs within the target window. In some embodiments, the target window comprises the intended edited base pair. In some embodiments, the nucleobase editor is any one of the base editors provided herein.

Pharmaceutical Compositions

Other aspects of the present disclosure relate to pharmaceutical compositions comprising any of the adenosine deaminases, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

As used here, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) $C_2$-$C_{12}$ alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, Science 249:1527-1533; Sefton, 1989, CRC Crit. Ref. Biomed. Eng. 14:201; Buchwald et al., 1980, Surgery 88:507; Saudek et al., 1989, N. Engl. J. Med. 321:574). In another embodiment, polymeric materials can be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, Macromol. Sci. Rev. Macromol. Chem. 23:61. See also Levy et al., 1985, Science 228:190; During et al., 1989, Ann. Neurol. 25:351; Howard et al., 1989, J. Neurosurg. 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition can be contained within a lipid particle or vesicle, such as a liposome or microcrystal, which is also suitable for parenteral administration. The particles can be of any suitable structure, such as unilamellar or plurilamellar, so long as compositions are contained therein. Compounds can be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., Gene Ther. 1999, 6:1438-47). Positively charged lipids such as N-[1-(2, 3-dioleoyloxi)propyl]-N,N,N-trimethyl-amoniummethyl-sulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition can be provided as a pharmaceutical kit comprising (a) a container containing a compound of the invention in lyophilized form and (b) a second container containing a pharmaceutically acceptable diluent (e.g., sterile water) for injection. The pharmaceutically acceptable diluent can be used for reconstitution or dilution of the lyophilized compound of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the invention. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Kits, Vectors, Cells

Some aspects of this disclosure provide kits comprising a nucleic acid construct comprising a nucleotide sequence encoding an adenosine deaminase capable of deaminating an adenosine in a deoxyribonucleic acid (DNA) molecule. In some embodiments, the nucleotide sequence encodes any of the adenosine deaminases provided herein. In some embodiments, the nucleotide sequence comprises a heterologous promoter that drives expression of the adenosine deaminase.

Some aspects of this disclosure provide kits comprising a nucleic acid construct, comprising (a) a nucleotide sequence encoding a napDNAbp (e.g., a Cas9 domain) fused to an adenosine deaminase, or a fusion protein comprising a napDNAbp (e.g., Cas9 domain) and an adenosine deaminase as provided herein; and (b) a heterologous promoter that drives expression of the sequence of (a). In some embodiments, the kit further comprises an expression construct encoding a guide nucleic acid backbone, (e.g., a guide RNA backbone), wherein the construct comprises a cloning site positioned to allow the cloning of a nucleic acid sequence identical or complementary to a target sequence into the guide nucleic acid (e.g., guide RNA backbone).

Some aspects of this disclosure provide cells comprising any of the adenosine deaminases, fusion proteins, or complexes provided herein. In some embodiments, the cells comprise a nucleotide that encodes any of the adenosine deaminases or fusion proteins provided herein. In some embodiments, the cells comprise any of the nucleotides or vectors provided herein.

The description of exemplary embodiments of the reporter systems above is provided for illustration purposes only and not meant to be limiting. Additional reporter systems, e.g., variations of the exemplary systems described in detail above, are also embraced by this disclosure.

It should be appreciated however, that additional fusion proteins would be apparent to the skilled artisan based on the present disclosure and knowledge in the art.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

Data provided in the below examples describe engineering of base editors that are capable of catalyzing hydrolytic deamination of adenosine (forming inosine, which base pairs like guanine (G)) in the context of DNA. There are no known naturally occurring adenosine deaminases that act on DNA. Instead, known adenosine deaminases act on RNA (e.g., tRNA or mRNA). The first deoxyadenosine deaminases were evolved to accept DNA substrates and deaminate deoxyadenosine (dA) to deoxyinosine. As one example, evolution experiments were performed using the adenosine deaminase acting on tRNA (ADAT) from *Escherichia coli* (TadA, for tRNA adenosine deaminase A), to engineer adenosine deaminases that act on DNA. Briefly, ecTadA was covalently fused to a dCas9 domain, and libraries of this fusion were assembled containing mutations in the deaminase portion of the construct. In the evolution experiments described below, several mutations in ecTadA were found to improve the ability of ecTadA to deaminate adenosine in DNA.

Example 1—Evolution of Adenosine Base Editors (Evolution #1)

Evolution of adenosine base editors (ABEs) was achieved by creating librars of an ecTadA-XTEN-dead Cas9 construct (pNMG-104) via error-prone PCR, which was mutagenized in the ecTadA portion of the editor only. Selection of editors capable of catalyzing A to I deamination on DNA (A to G reversion) was selected for using an antibiotic selection platform. For the first round of evolution (Evolution #1), an adenosine base editor (ABE) library was co-expressed with a gRNA that targeted an active site mutation in a chloramphenicol acetyl-transferase gene, which requires an A to G reversion to restore acetyl-transferase activity and subsequent survival on chloramphenicol selection media. The selection plasmid is co-transformed into the S1030 host strain along with the ABE library. Evolution #1 was conducted and mutations D108N and A106V were idenitified as two mutations which enable A to G reversions on DNA. The D108N mutation more efficiently induced A to G reversions in DNA than A106V. Sequence alignment studies with *S. aureus* TadA revealed that residue D108 participates in H-bond contacts with the 2' OH of the ribose sugar in the wild-type, tRNA substrate. In DNA, this 3' OH is replaced with a 3' H.

Wild-Type Adenosine Deaminases and A to G Deaminases

Figure 1:
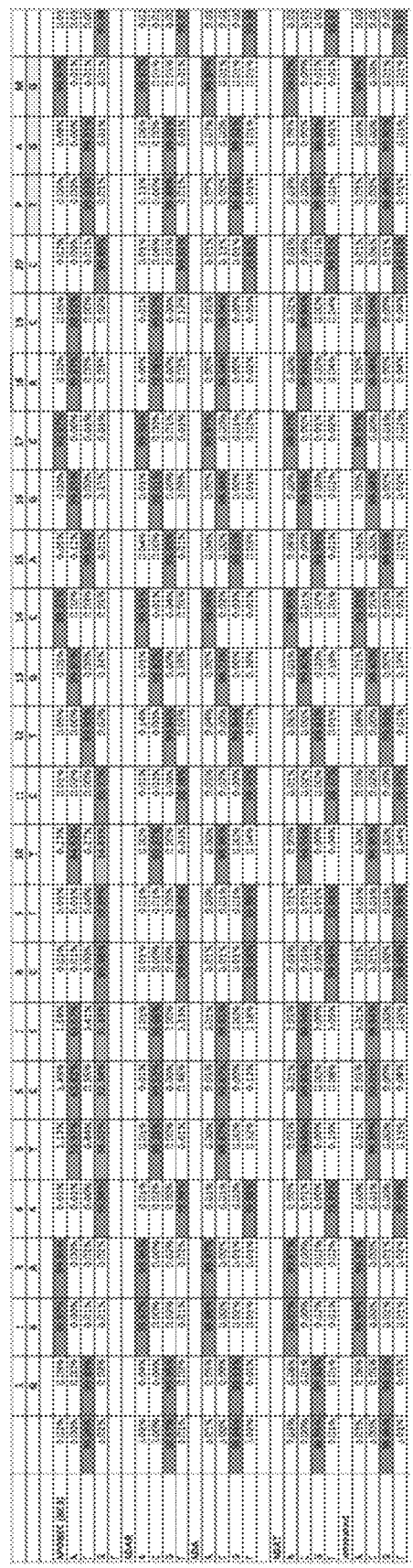
FIG. 1 shows high throughput screen results with various deaminases. APOBEC (BE3) is the positive control; ADAR acts on mRNA, ADA acts on deoxyadenosine, and ADAT acts on tRNA. The untreated group is the negative control. The sequence corresponds to SEQ ID: 45.

Transfection of various A to G deaminase fusions (+XTEN-nCas9) into Hek293T cells did not cause A to G SNP at the targeted sites. Six different sites were targeted, but none of the wild-type adenosine deaminase Cas9 fusions produced observable A to G modifications in DNA. BE3 (rAPOBEC1-XTEN-nCas9-UGI-NLS) was used as positive control. The following wild-type deaminase-nCas9 fusions were tested: ADAR (acts on mRNA), ADA (acts on deoxyadenosine), and ADAT (acts on tRNA) (FIG. 1).

Figure 2:
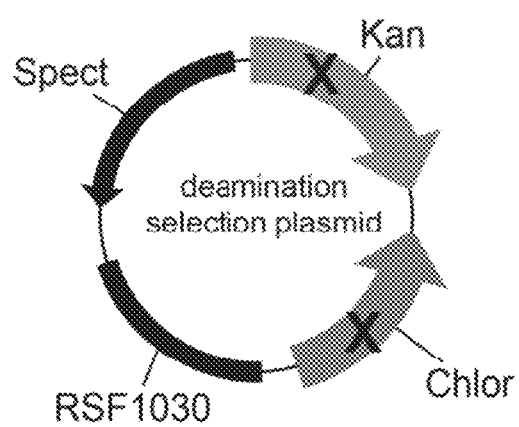
FIG. 2 is a schematic of a deamination selection plasmid.

A to G deaminases which act on DNA were developed. First, an antibiotic selection plasmid was developed, in which restoration of the active site residue in the antibiotic-resistant gene (A to G reversion) resulted in the host's resistance to antibiotic challenges. A high copy plasmid (RSF1030), was constructed. It required either a STOP reversion to a wild-type amino acid (Kan) or an active site residue restoration (Chlor). Specifically, on the template strand, the STOP needed to revert to glutamic acid (Kan) or tyrosine needed to revert to histidine (a cationic residue) (Chlor) (FIG. 2).

Figure 3:
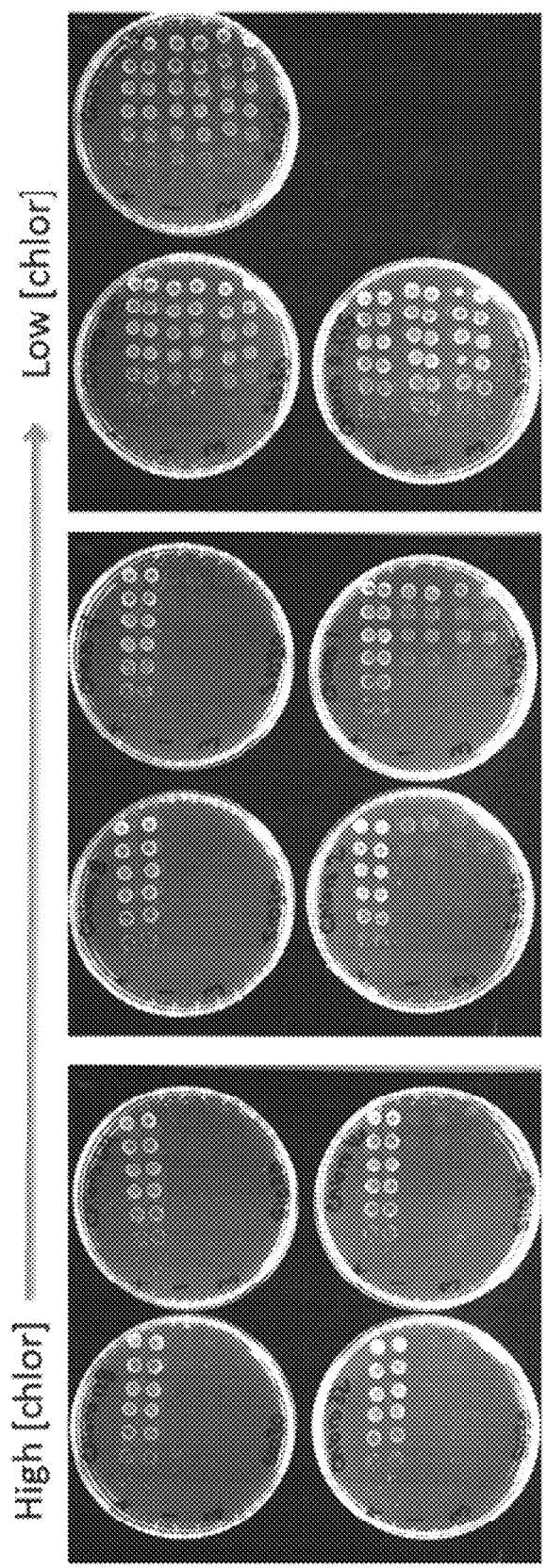
FIG. 3 shows a serial dilution of the selection plasmid in S1030 cells plated on increasing concentrations of chloramphenicol.

The minimum inhibitory concentration (MIC) was determined by the selection plasmid. The A to I selection plasmid was grown in S1030, and plated on varying concentrations of chloramphenicol. The MIC was found to be approximately 1 µg/mL. A serial dilution of the selection plasmid in S1030 cells (the host strain) plated on increasing concentrations of chlor (FIG. 3). Cells harboring library members which survive on concentrations of chlor above 1 µg/mL were considered to be possible hits.

Figure 4:
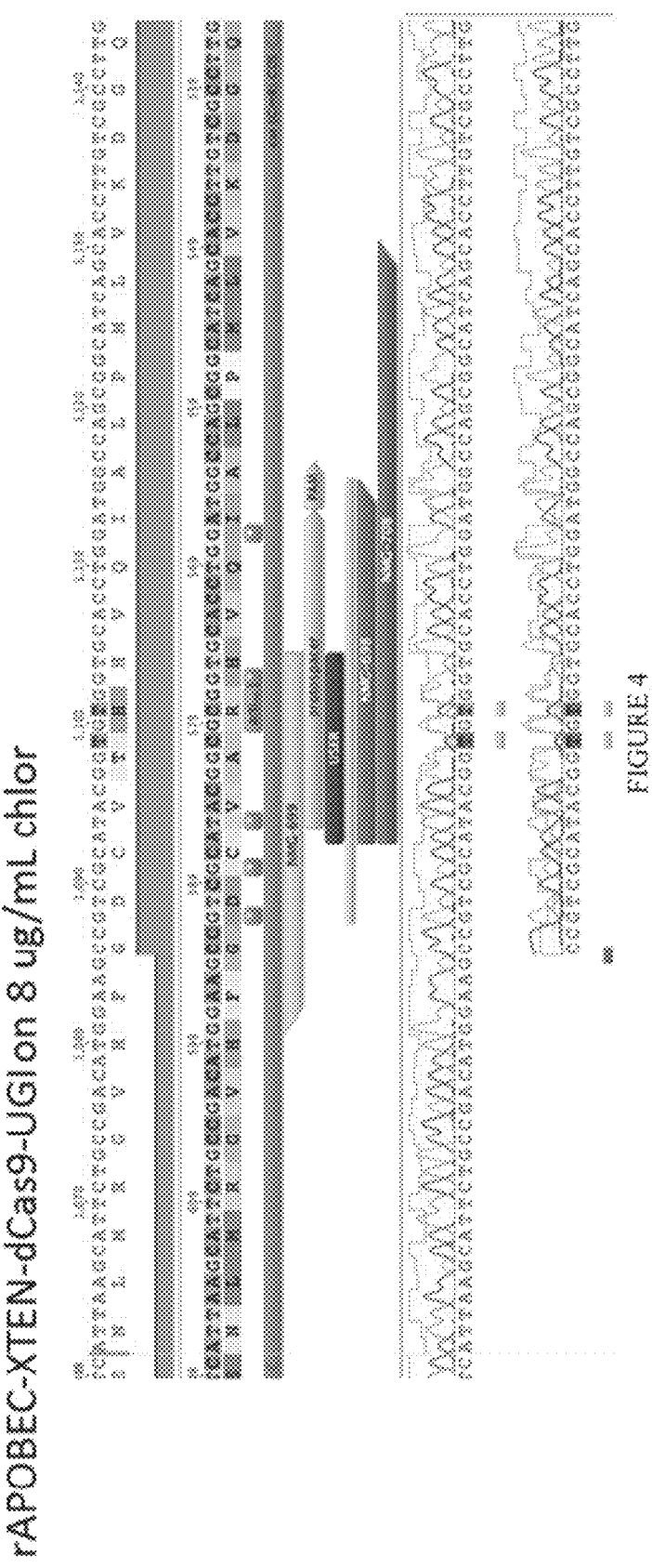
FIG. 4 shows the validation of chloramphenicol selection with a rAPOBEC1-XTEN-dCas9 construct as a positive control. The sequences from top to bottom correspond to SEQ ID NOs: 95 (the nucleotide sequence), 96 (the amino acid sequence), 97 (the nucleotide sequence), 98 (the amino acid sequence), 95 (the nucleotide sequence) and 99 (the truncated nucleotide sequence).

The chloramphenicol (Chlor) selection was further validated using rAPOBEC1-XTEN-dCas9 construct as a positive control. Colonies that survived at 8 µg/mL chlor were then sequenced, and the C to T reversion was observed in DNA (FIG. 4). The assay was performed by growing cells with the selection plasmid and deaminase fusion to $OD_{600\ nm}$~0.3 and then inducing fusion expression overnight. The resulting culture was then plated on increasing concentrations of chloramphenicol and the desired DNA reversion was screened.

An A to I deaminase library was then generated. Optimized assembly/library generation conditions, including PreCR vs. USER, electroporation vs. chemical composition, nucleofection vs. electroporation, outgrowth time, SOC vx. DRM, and sub-cloning vs. direct transformation, were examined. After the library assembly/electroporation conditions were optimized the following two libraries were made: APOBEC-XTEN-dCas9 and ADAT-XTEN-dCas9. The average library size was $2-4 \times 10^6$ based on the calculated colony-forming unit (CFU). The APOBEC-XTEN-dCas9 library produced no useful hits. The ADAT-XTEN-dCas9 library produced successful. The ADAT used was TadA (truncated) in E. coli.

Architecture of the Deaminase Library

Figure 5:
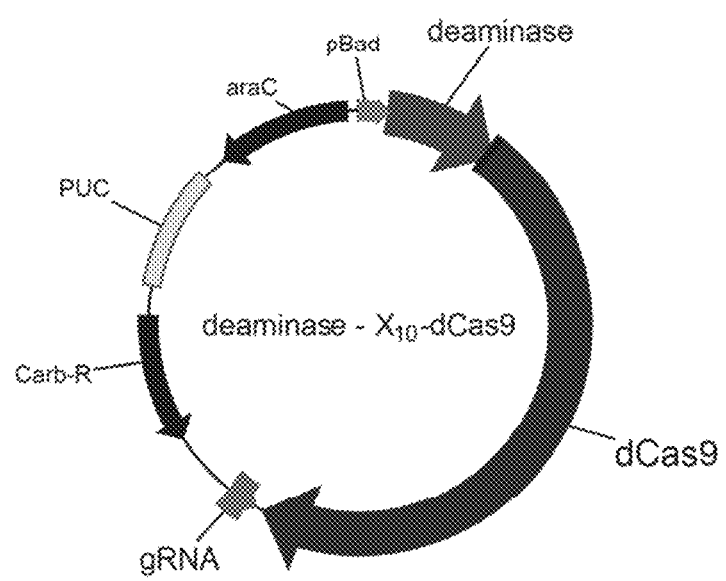
FIG. 5 is a schematic of a deaminase-XTEN-dCas9 construct.

The deaminase-XTEN-dCas9 fusion includes a SC101 backbone and a gRNA (lac promoter) to target the chloramphernicol site (FIG. 5). Only deaminase is subjected to error-prone PCR, and the assembly is two-piece PreCR (a modified USER protocol). The gRNA is driven by the lac promoter; it targets the Chlor active site. A to G reversion is needed at position 9 of the protospacer to restore the His active site (a tyrosine to histidine reversion). Repair is needed and targeted on the template strand. APOBEC/CDA was used as a positive control. A to I constructs included the following: mADA, ADAR1, and ADAT2.

Figure 6:
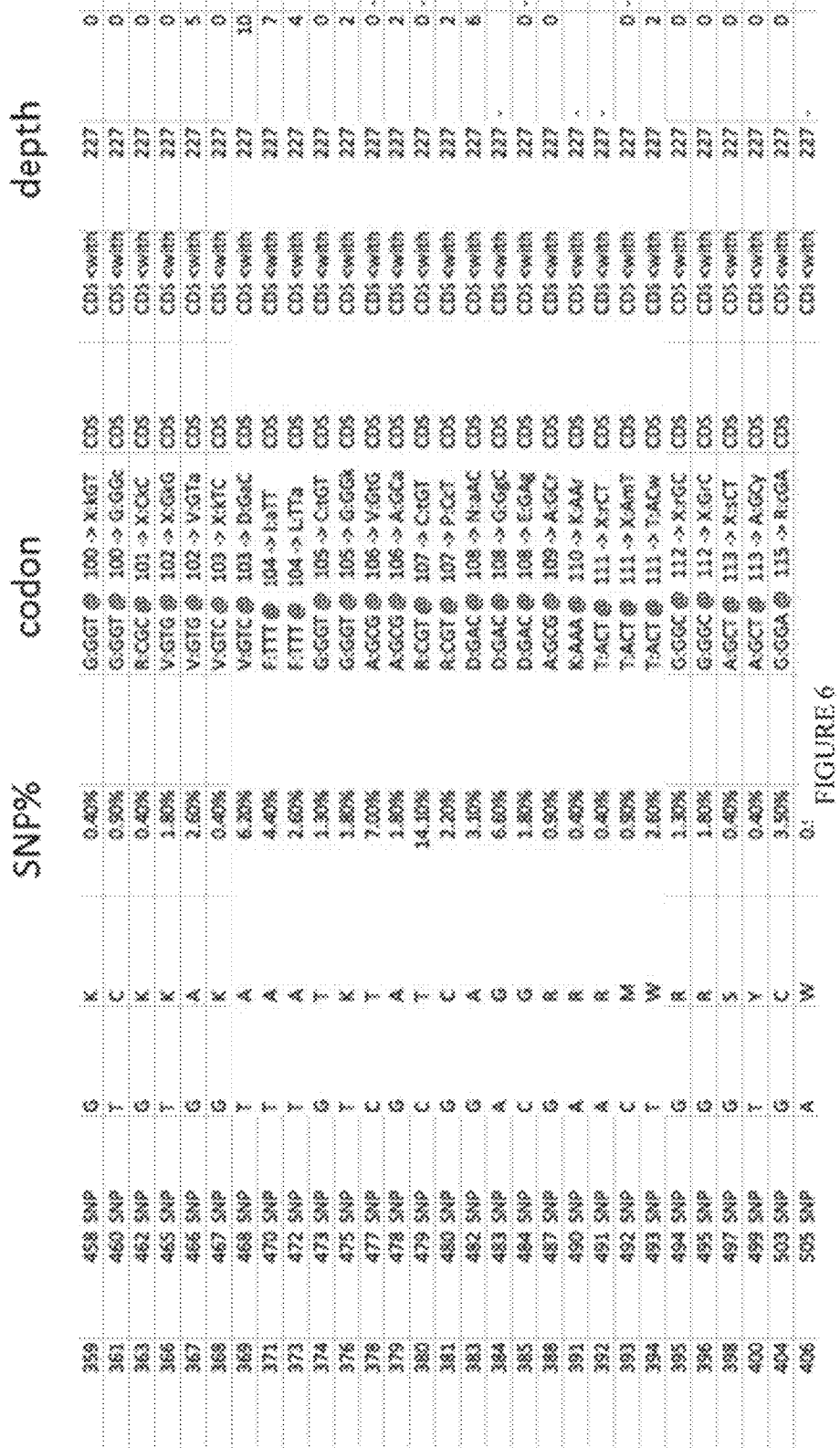
FIG. 6 shows the sequencing results from the first round of the TadA-XTEN-dCas9 library.
Figure 7:
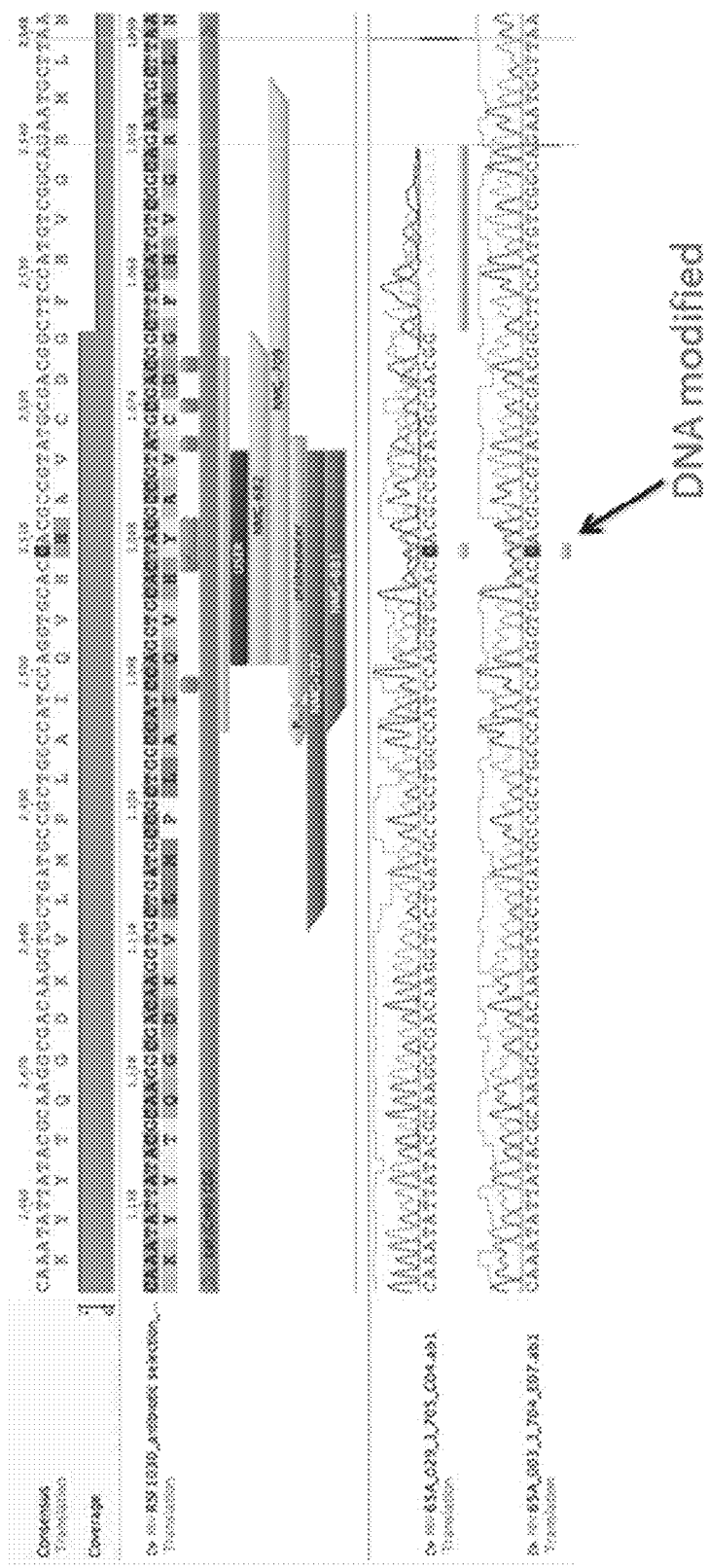
FIG. 7 shows the sequence of a selection plasmid; an A to G reversion was observed. The sequences from top to bottom correspond to SEQ ID NOs: 100 (the nucleotide sequence), 101 (the amino acid sequence), 102 (the nucleotide sequence), 103 (the amino acid sequence), 104 (the nucleotide sequence), and 100 (the nucleotide sequence).

A TadA-XTEN-dCas9 library was also constructed. Error Prone PCR on TadA enzyme only was used. The optimized protocol was used and resulting constructs were subcloned. S1030 cells (with the selection plasmid) were transformed with a TadA*-XTEN-dCas9 randomized library. Protein expression was induced after a recovery phase. The library was then plated the next day on increasing concentrations of chloramphenicol (0.5, 1, 2, and 4 µg/mL) onto separate 24×24 cm plates and incubated overnight. TadA(wt)-XTEN-dCas9 was used as a negative control. Colonies grew on all four places, and as concentrations increased, fewer colonies were observed. The negative control had far fewer colonies than the plates with library members. Eight selection plasmids were sequenced and all plasmids contained the A to G reversion at the targeted site. In all, 120 colonies were PCR-amplified and then sequenced. The results of the first round of sequencing are shown in FIG. 6. An exemplary sequence of a selection plasmid with the A to G reversion is given in FIG. 7. The target is the template strand's A to G (observed as T to C in coding). The example shows about 50% reversion in the Sanger trace (Y to H).

Figure 8:
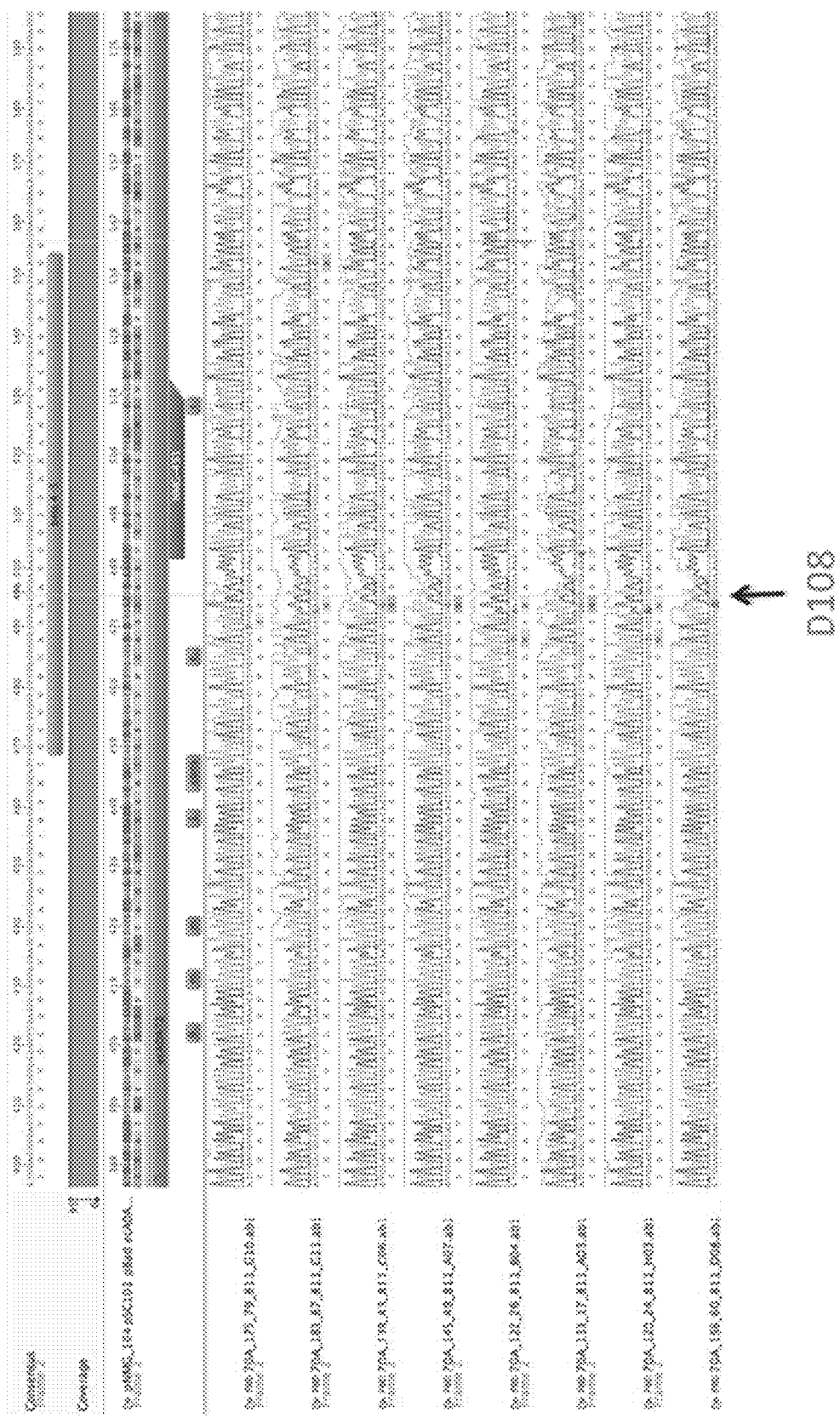
FIG. 8 shows the results of deaminase sequencing, illustrating the convergence at residue D108. The sequences correspond to SEQ ID NOs: 589-607 from top to bottom.
Figure 9:
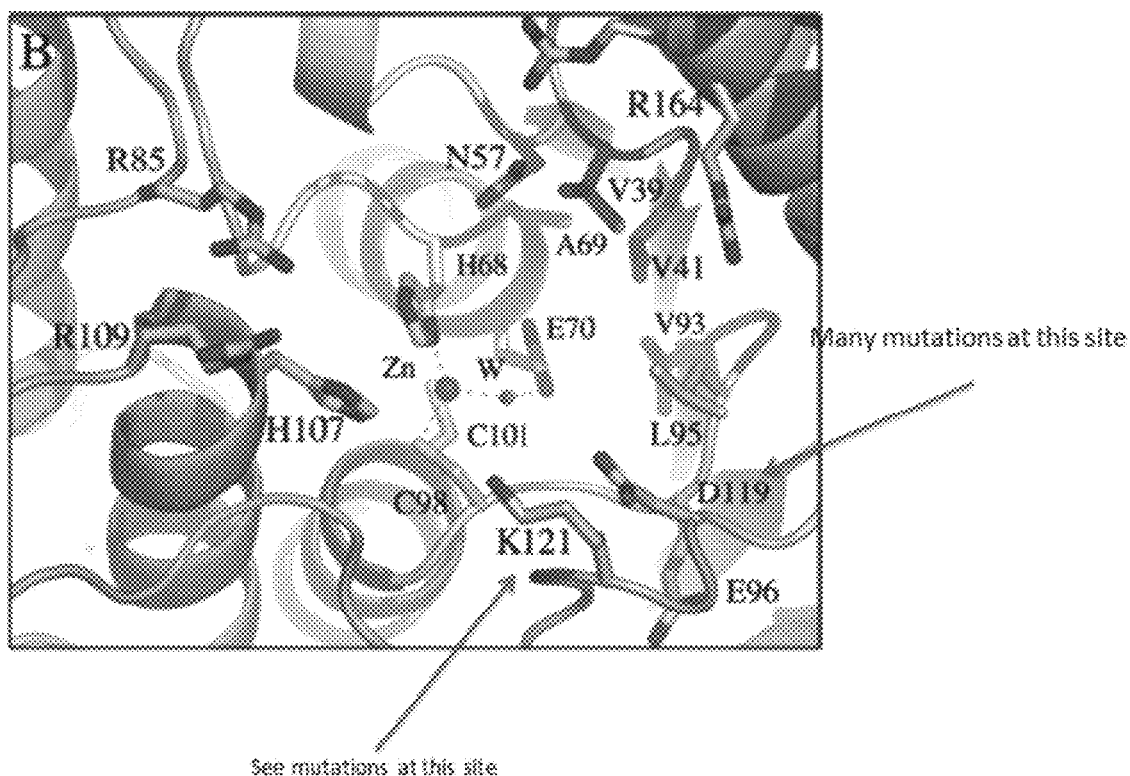
FIG. 9 shows the *E. coli* TadA crystal structure. Note that D119 in the figure corresponds to D108, as the residue numbering is offset in the figure.
Figure 10:
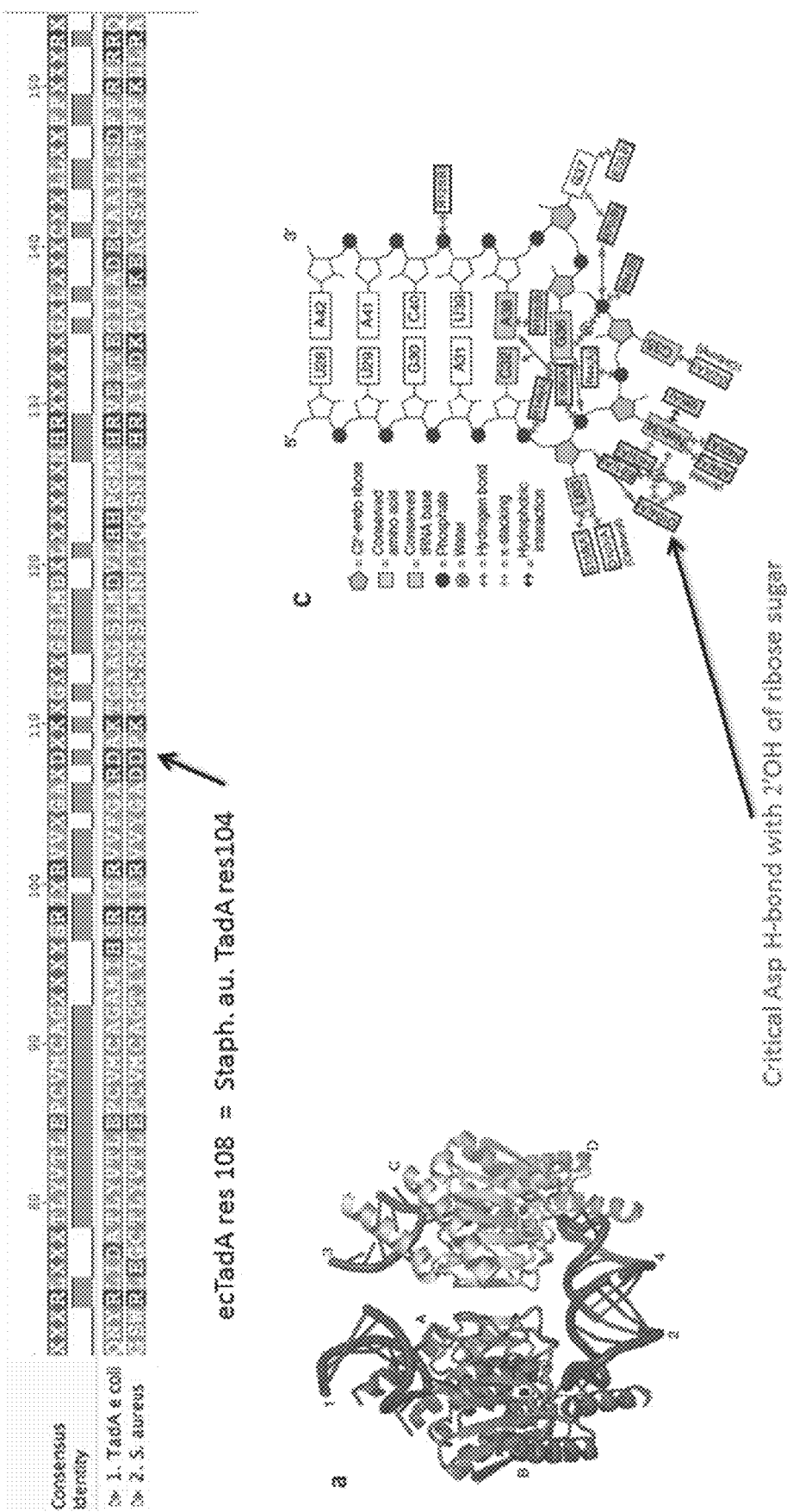
FIG. 10 shows the crystal structure of TadA (in *S. aureus*) tRNA and an alignment of with TadA from *E. coli*. The sequences from top to bottom correspond to SEQ ID NOs: 105-107.

A convergence at residue D108 was observed (FIG. 8). The crystal show of E. coli TadA is shown in FIG. 9. D119 in the figure is D108, as the residue numbers are offset. Many mutations were found to occur in that residue. FIG. 10 shows the crystal structure of Tad A (S. aureus) and aligns the sequences with that of E. coli. ecTadA residue 108 is equivalent to S. aureus TadA residue 104, which is part of a critical asparagine hydrogen bond with 2'OH of a ribose sugar.

Selection plasmids used in the evolution experiments contain mutations in various antibiotic resistance genes, which are targeted by adenosine base editors. Below are target sequences of the various antibiotic resistance genes (SEQ ID NOs: 441-444), where the targeted adenine required to restore resistance to its respective antibiotic is shown in bold and underlined. The plasmids used were high-copy plasmids with a RSF1030 origin.

```
Chloramphenicol target (H193Y):
                                    (SEQ ID NO: 441)
5'-TACGGCGTAGTGCACCTGGA-3'

Kanamycin target 1 (Q4Term):
                                    (SEQ ID NO: 442)
5'-ATCTTATTCGATCATGCGAA-3'

Kanamycing target 2 (W15Term):
                                    (SEQ ID NO: 443)
5'-GCTTAGGTGGAGCGCCTATT-3'

Spectinomycin target (T89I):
                                    (SEQ ID NO: 444)
5'-CAATGATGACTTCTACAGCG-3'
```

Mammalian codon optimized constructs were made by ordering a mammalian codon optimized version of ecTadA from Integrated Dna Technologies (IDT) as a gene block. This gene block was used to make pNMG-142, which served as a template for all subsequent mammalian codon-optimized constructs. See Table 4. After mutations were identified from the various rounds of evolution, primers were designed and ordered to introduce desired mutation(s) into the mammalian construct.

ecTadA Evolution and Challenge

Figure 11:
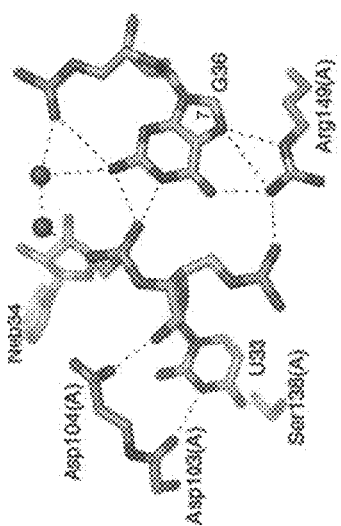
FIG. 11 shows results from the isolation and challenge of individual constructs from ecTadA evolution.

Individual constructs from the ecTadA evolution were isolated and challenged. Sixteen clones were sub-cloned, resulting in the first round of evolution. Each of the 16 clones were transformed in S1030 cells with selection plasmid and challenged with increasing doses of chloramphenicol. rAPOBEC1-XTEN-dCas9, which has a C to T reversion at the same site, was used as a control. The results are shown in FIGS. 11 and 12. FIG. 12 shows the C.F.U. of various constructs challenged on increasing concentrations of chloramphenicol. Constructs 3 and 4 performed the best under the assay's conditions. D108N is a key mutation.

Figure 19:
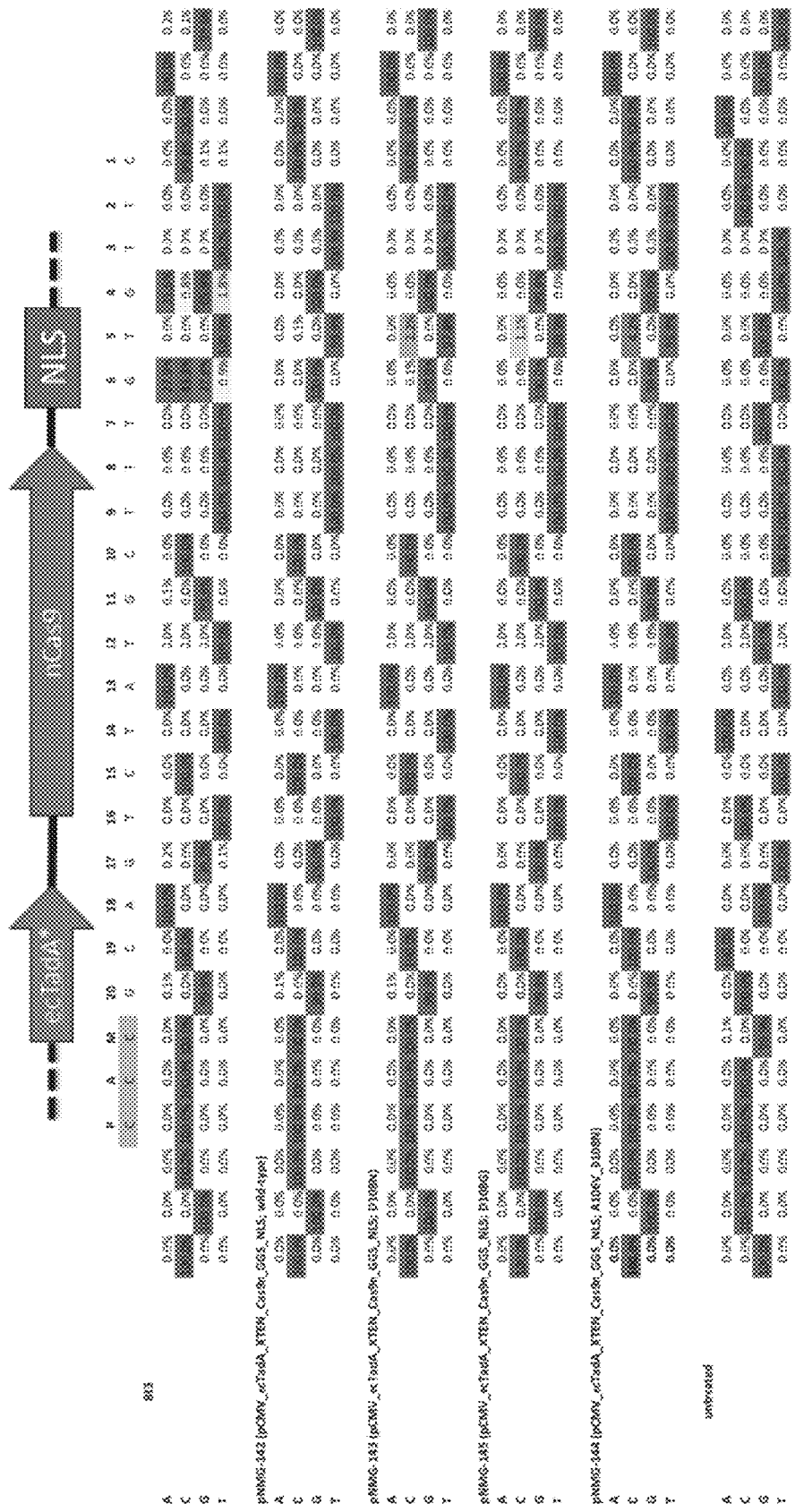
FIG. 19 shows the transfection of constructs into mammalian cells containing single or double mutations in ecTadA. The sequence corresponds to SEQ ID NO: 41.
Figure 20:
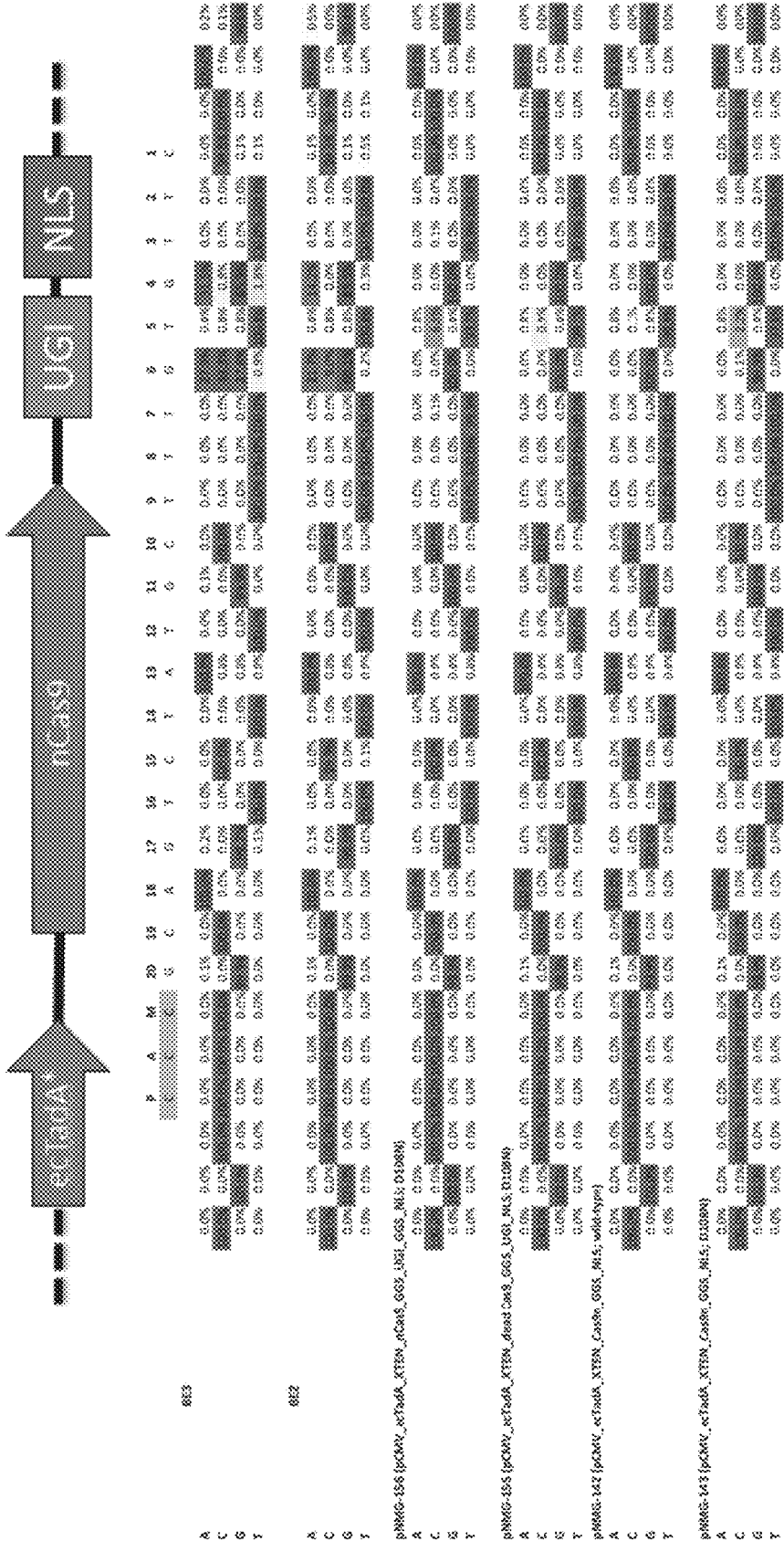
FIG. 20 shows the transfection of constructs with the addition of UGI to adenosine nucleobase editor (ABE) (D108N). The sequence corresponds to SEQ ID NO: 41.
Figure 22:
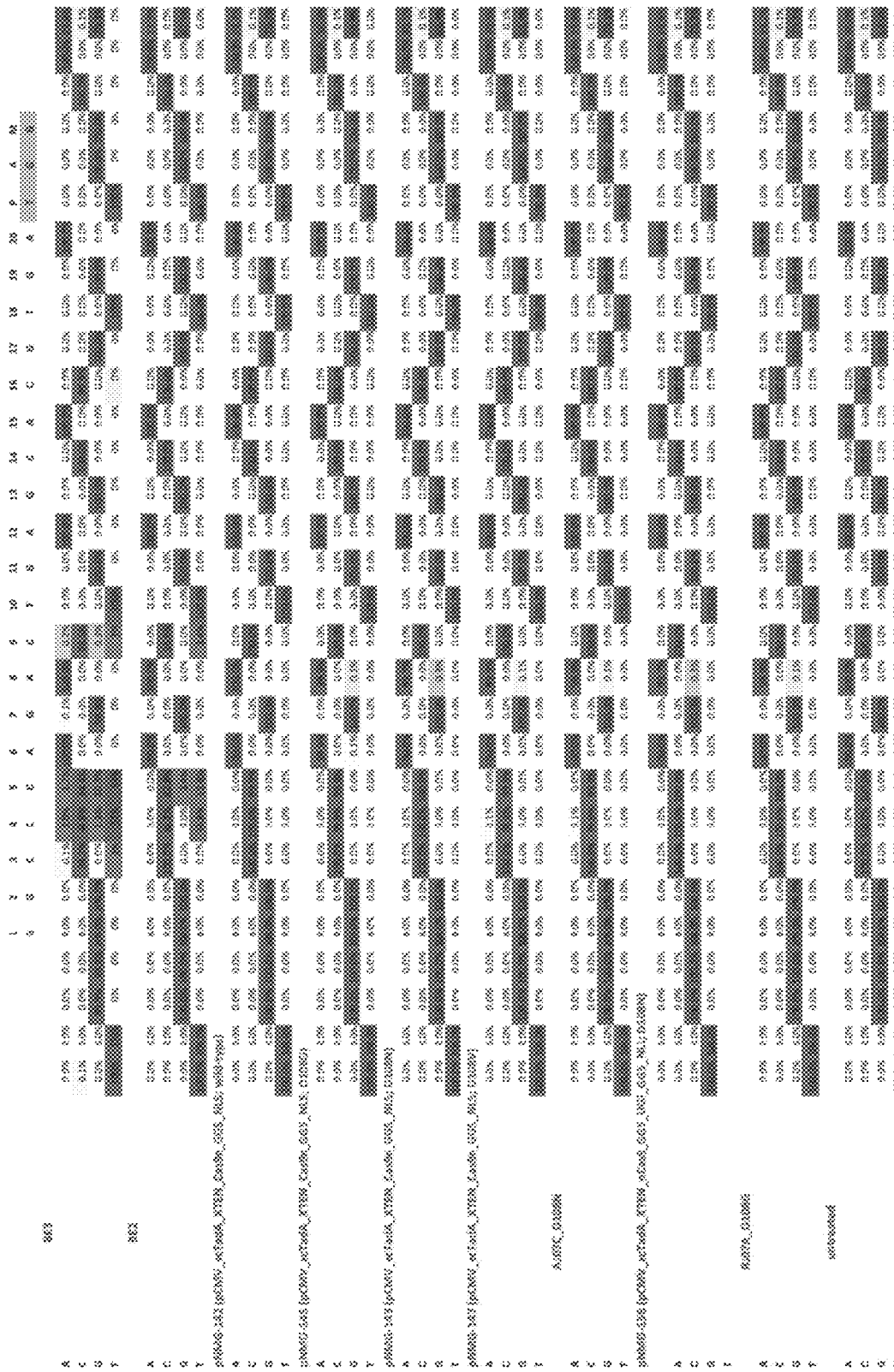
FIG. 22 shows that the Hek-3 site also has lower editing relative to the Hek-2 site editing at position 8 of the protospacer. The sequence corresponds to SEQ ID NO: 42.

Base editors, having mutations at residue D108 of ecTadA are capable of generating an adenine to guanine mutation in DNA via hydrolytic deamination of adenine, which results in inosine formation at the adenine site. Inosine is the read as guanine by DNA polymerase. See FIGS. 18-22, and 129-139, which show the ability of various base editors to generate an adenine to guanine mutation in DNA in various target DNA sequences, such as Hek2 (FIGS. 19, 20, and 129), Hek 2-1 (FIG. 130), Hek 2-2 (FIG. 131), Hek 2-3 (FIG. 132), Hek 2-4 (FIG. 133), Hek 2-6 (FIG. 134), Hek 2-9 (FIG. 135), Hek 2-10 (FIG. 136), RNF2 (FIG. 138), FANCF (FIG. 139), EMX1 (FIG. 21), and Hek3 (FIGS. 22 and 137). In these experiments the D108N mutation as most efficient for generating an A to G mutation, with the addition of an A106V mutation improving efficiency further. Additionally, base editors more efficiently generated A to G mutations at the Hek2 site than any other site tested. In the figures, BE3 and BE2 refer to base editors that induce C to G mutations and act as a positive control for C to G base editing.

Figure 13:
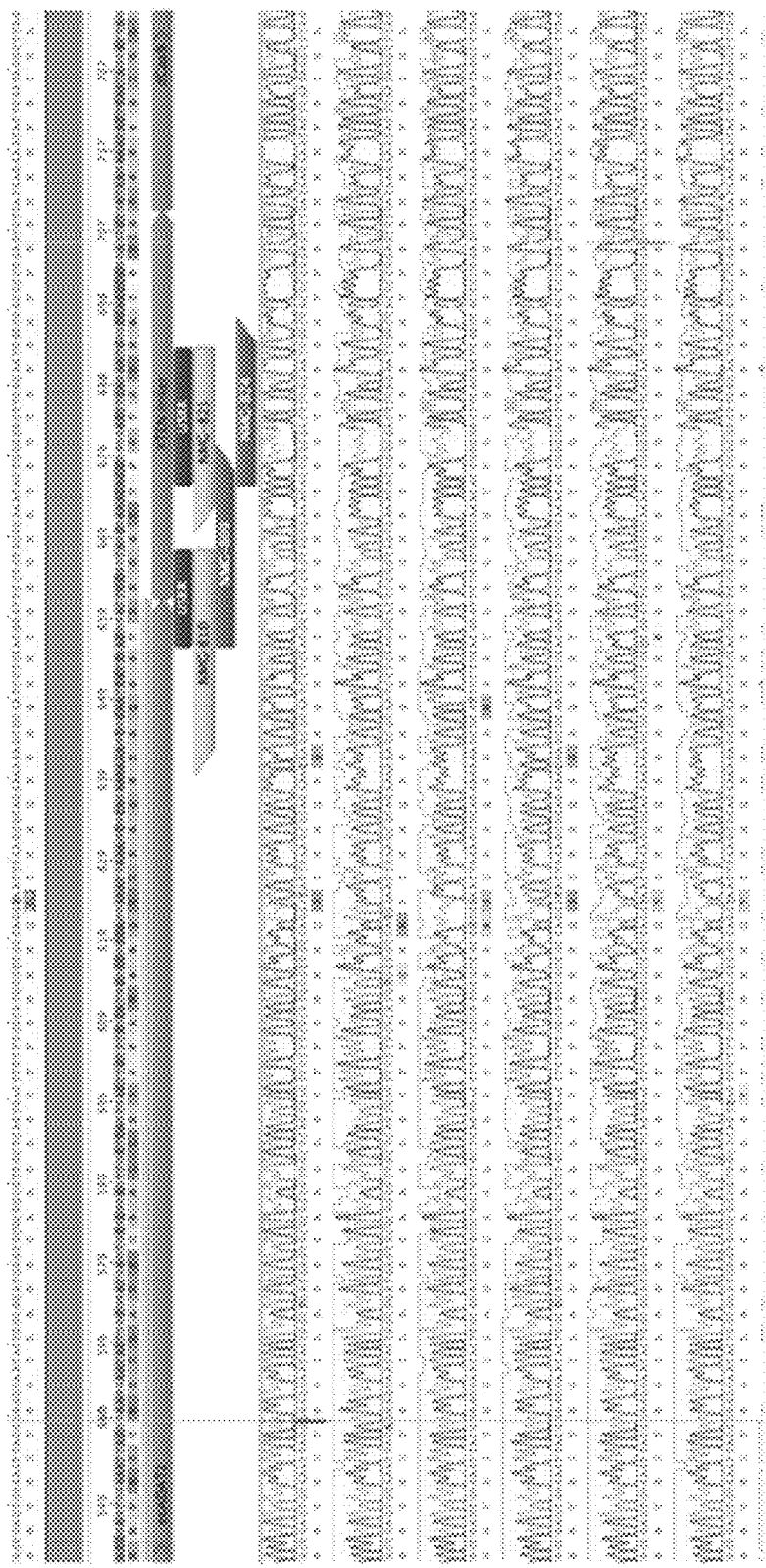
FIG. 13 shows data from the second round of evolution from the constructs containing the D108N mutation. The sequences from top to bottom correspond to SEQ ID NOs: 608-623.

A second round of evolution, described in greater detail below, was performed. Constructs containing the D108N mutation were randomized (plasmid NMG-128). The selection assay was repeated, and the clones were challenged with high concentrations of chloramphenicol. The resulting material was sub-cloned, and the selection assay was repeated. The resulting colonies that survived on high concentrations of chloramphenicol were then sequenced. An enrichment of mutations at position E155 was observed (FIG. 13).

A to G Editing in Mammalian Cells

Figure 14:
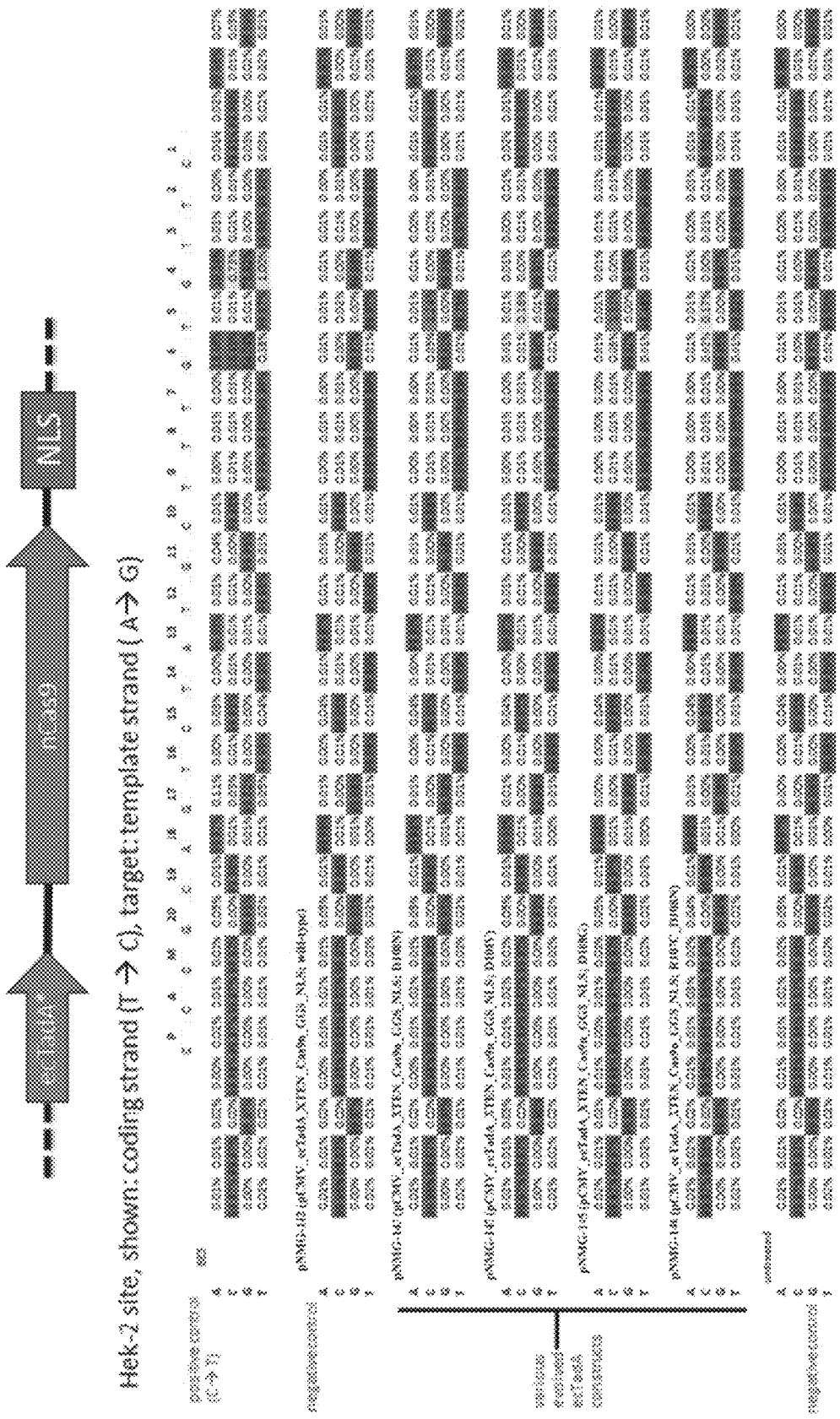
FIG. 14 shows A to G editing in mammalian cells. The sequence corresponds to SEQ ID NO: 41.

A to G editing in was examined in mammalian (Hek293T) cells. As shown in FIG. 14, the editing (from A to G) occurred in the various evolved ecTadA constructs, while it did not occur in the negative controls. The constructs used in the experiments described herein (e.g., Evolution #1-#7) are shown in Table 4. Table 4 includes the construct name, the construct architecture, and the ecTadA mutations. In table 4, pCMV refers to the expression vector comprising the construct. ecTadA refers to the ecTadA of SEQ ID NO: 1, however, for constructs comprising two ecTadA sequences, the second (C-terminal to the first ecTadA) ecTadA sequence does not comprise an N-terminal methionine. Table 4 also lists the mutations in ecTadA relative to SEQ ID NO: 1. Wild-type ecTadA refers to SEQ ID NO: 1. When two ecTadA domains are present the mutations in both ecTadA domains are indicated with the N-terminal ecTadA being indicated first. The 24 a.a linker refers to the amino acid sequence SGGSSGGSSGSETPGTSESATPES (SEQ ID NO: 685), the 32 a.a linker refers to the amino acid sequence SGGSSGGSSGSETPGTSESATPESSGGSSGGS (SEQ ID NO: 385), the 40 a.a linker refers to the amino acid sequence SGGSSGGSSGSETPGTSESATPESSGGSSGGSSGGSSGGS (SEQ ID NO: 686), the 64 a.a linker refers to the amino acid sequence SGGSSGGSSGSETPGTSESATPESSGGSSGGSSGGSSGGSSGSETPGTSESATPESSGGS SGGS (SEQ ID NO: 687), and the 92 a.a. linker refers to the amino acid sequence PGSPAGSPTSTEEGTSESATPESGPGTSTEPSEGSAPGSPAGSPTSTEEGTSTEPSEGSAP GTSTEPSEGSAPGTSESATPESGPGSEPATS (SEQ ID NO: 688).

TABLE 4

Plasmid Identity Key

| Name | Construct Architecture | Mutations in TadA |
|---|---|---|
| pNMG-142 | pCMV_ecTadA_XTEN_Cas9n_SGGS_NLS | wild-type |
| pNMG-143 | pCMV_ecTadA_XTEN_Cas9n_SGGS_NLS | D108N |
| pNMG-144 | pCMV_ecTadA_XTEN_Cas9n_SGGS_NLS | A106V_D108N |
| pNMG-145 | pCMV_ecTadA_XTEN_Cas9n_SGGS_NLS | D108 |
| pNMG-146 | pCMV_ecTadA_XTEN_Cas9n_SGGS_NLS | R107C_D108N |
| pNMG-147 | pCMV_ecTadA_XTEN_Cas9n_SGGS_NLS | D108V |
| pNMG-155 | pCMV_ecTadA_XTEN_dead Cas9_SGGS_UGI_NLS | D108N |
| pNMG-156 | pCMV_ecTadA_XTEN_nCas9_SGGS_UGI_SGGS_NLS | D108N |
| pNMG-157 | pCMV_ecTadA_XTEN_dead Cas9_SGGS_UGI_SGGS_NLS | D108G |
| pNMG-158 | pCMV_ecTadA_XTEN_nCas9_SGGS_UGI_SGGS_NLS | D108G |
| pNMG-160 | pCMV_ecTadA_XTEN_nCas9_SGGS_AAG*(E125Q)_SGGS_NLS | D108N |
| pNMG-161 | pCMV_ecTadA_XTEN_Cas9n_SGGS_EndoV*(D35A)_NLS | D108N |
| pNMG-162 | pCMV_ecTadA_XTEN_Cas9n_SGGS_NLS | H8Y_D108N_S127S_D147Y_Q154H |
| pNMG-163 | pCMV_ecTadA_XTEN_Cas9n_SGGS_NLS | H8Y_R24W_D108N_N127S_D147Y_E155V |
| pNMG-164 | pCMV_ecTadA_XTEN_Cas9n_SGGS_NLS | D108N_D147Y_E155V |
| pNMG-165 | pCMV_ecTadA_XTEN_Cas9n_SGGS_NLS | H8Y_D108N_S127S |
| pNMG-171 | pCMV_Cas9n_XTEN_ecTadA_SGGS_NLS | wild-type |
| pNMG-172 | pCMV_Cas9n_XTEN_ecTadA_SGGS_NLS | D108N |
| pNMG-173 | pCMV_Cas9n_XTEN_ecTadA_SGGS_NLS | H8Y_D108N_N127S_D147Y_Q154H |
| pNMG-174 | pCMV_Cas9n_XTEN_ecTadA_SGGS_NLS | H8Y_R24W_D108N_N127S_D147Y_E155V |
| pNMG-175 | pCMV_Cas9n_XTEN_ecTadA_SGGS_NLS | D108N_D147Y_E155V |
| pNMG-176 | pCMV_Cas9n_XTEN_ecTadA_SGGS_NLS | H8Y_D108N_S127S |
| pNMG-177 | pCMV_ecTadA_XTEN_Cas9n_SGGS_NLS | A106V_D108N_D147Y_E155V |
| pNMG-178 | pCMV_ecTadA_XTEN_Cas9n_SGGS_UGI_SGGS_NLS | D108N_D147Y_E155V |
| pNMG-179 | pCMV_ecTadA_XTEN_Cas9n_SGGS_AAG*(E125Q)_SGGS_NLS | A106V_D108N_D147Y_E155V |
| pNMG-180 | pCMV_ecTadA_XTEN_Cas9n_SGGS_UGI_SGGS_NLS | A106V_D108N_D147Y_E155V |
| pNMG-181 | pCMV_ecTadA_XTEN_Cas9n_SGGS_AAG*(E125Q)_SGGS_NLS | D108N_D147Y_E155V |
| pNMG-182 | pCMV_ecTadA_SGGS_nCas9_SGGS_NLS | D108N_D147Y_E155V |
| pNMG-183 | pCMV_ecTadA_(SGGS)2-XTEN-(SGGS)2_nCas9_SGGS_NLS | D108N_D147Y_E155V |
| pNMG-235 | pCMV_ecTadA_XTEN_Cas9n_XTEN_AAG*(E125A)_SGGS_NLS | A106V_D108N_D147Y_E155V |
| pNMG-236 | pCMV_ecTadA_XTEN_Cas9n_XTEN_AAG*(E125Q)_SGGS_NLS | A106V_D108N_D147Y_E155V |
| pNMG-237 | pCMV_ecTadA_XTEN_Cas9n_XTEN_AAG*(wt)_SGGS_NLS | A106V_D108N_D147Y_E155V |
| pNMG-238 | pCMV_AAG*(E125A)_XTEN_ecTadA_XTEN_Cas9n_SGGS_NLS | A106V_D108N_D147Y_E155V |
| pNMG-239 | pCMV_AAG*(wt)_XTEN_ecTadA_XTEN_Cas9n_SGGS_NLS | A106V_D108N_D147Y_E155V |
| pNMG-240 | pCMV_ecTadA_XTEN_Cas9n_XTEN_EndoV*(D35A)_SGGS_NLS | A106V_D108N_D147Y_E155V |
| pNMG-241 | pCMV_ecTadA_XTEN_Cas9n_XTEN_EndoV*(wt)_SGGS_NLS | A106V_D108N_D147Y_E155V |
| pNMG-242 | pCMV_EndoV*(D35A)_XTEN_ecTadA_XTEN_Cas9n_SGGS_NLS | A106V_D108N_D147Y_E155V |
| pNMG-243 | pCMV_EndoV*(wt)_XTEN_ecTadA_XTEN_Cas9n_SGGS_NLS | A106V_D108N_D147Y_E155V |
| pNMG-247 | pCMV_ecTadA_SGGS_UGI_SGGS_Cas9 (wild-type)_SGGS_NLS | wild-type |
| pNMG-248 | pCMV_ecTadA_XTEN_Cas9 (wild-type)_SGGS_NLS | D108N_D147Y_E155V |
| pNMG-249 | pCMV_ecTadA_SGGS_Cas9 (wild-type)_SGGS_NLS | A106V_D108N_D147Y_E155V |
| pNMG-250 | pCMV_ecTadA_SGGS_UGI_SGGS_Cas9 (wild-type)_SGGS_UGI_SGGS_NLS | A106V_D108N_D147Y_E155V |
| pNMG-251 | pCMV_ecTadA_SGGS_AAG*(E125Q)_SGGS_NLS | |
| pNMG-274 | pCMV_ecTadA_SGGS_NLS (no Cas9 fusion) | wild-type |
| pNMG-275 | pCMV_ecTadA_SGGS_NLS (no Cas9 fusion) | A106V_D108N_D147Y_E155V |

TABLE 4-continued

| Name | Construct Architecture | Mutations in TadA |
|---|---|---|
| pNMG-276 | pCMV_ecTadA-(SGGS)2-XTEN-(SGGS)2_ecTadA_XTEN_nCas9_SGGS_NLS | (wild-type) + (wild-type) |
| pNMG-277 | pCMV_ecTadA-(SGGS)2-XTEN-(SGGS)2_ecTadA_XTEN_nCas9_SGGS_NLS | (A106V_D108N_D147Y_E155V) + (A106V_D108N_D147Y_E155V) |
| pNMG-278 | pCMV_ecTadA_XTEN_nCas9_SGGS_NLS | D108Q_D147Y_E155V |
| pNMG-279 | pCMV_ecTadA_XTEN_nCas9_SGGS_NLS | D108M_D147Y_E155V |
| pNMG-280 | pCMV_ecTadA_XTEN_nCas9_SGGS_NLS | D108L_D147Y_E155V |
| pNMG-281 | pCMV_ecTadA_XTEN_nCas9_SGGS_NLS | D108K_D147Y_E155V |
| pNMG-282 | pCMV_ecTadA_XTEN_nCas9_SGGS_NLS | D108I_D147Y_E155V |
| pNMG-283 | pCMV_ecTadA_XTEN_nCas9_SGGS_NLS | D108F_D147Y_E155V |
| pNMG-284 | pCMV_ecTadA_LONGER LINKER (92 a.a.)_ecTadA_XTEN_nCas9_SGGS_NLS | (wild-type) + (A106V_D108N_D147Y_E155V) |
| pNMG-285 | pCMV_ecTadA_LONGER LINKER (92 a.a.)_ecTadA_XTEN_nCas9_SGGS_NLS | (A106V_D108N_D147Y_E155V) + (A106V_D108N_D147Y) |
| pNMG-285b | pCMV_ecTadA_LONGER LINKER (92 a.a.)_ecTadA_XTEN_nCas9_SGGS_NLS | (A106V_D108N_D147Y_E155V) + (A106V_D108N_D147Y_E155V) |
| pNMG-286 | pCMV_ecTadA_XTEN_nCas9_SGGS_NLS | A106V_D108M_D147Y_E155V |
| pNMG-287 | pCMV_ecTadA-(SGGS)2-XTEN-(SGGS)2_ecTadA_XTEN-nCas9 (S.aureus)_SGGS_NLS | (A106V_D108N_D147Y_E155V) + (A106V_D108N_D147Y_E155V) |
| pNMG-289 | pCMV_ecTadA-(SGGS)2-XTEN-(SGGS)2_ecTadA_XTEN_nCas9_SGGS_NLS | (A106V_D108N_D147Y_E155V) + (A106V_D108N_D147Y_E155V) |
| pNMG-290 | pCMV_ecTadA-(SGGS)2-XTEN-(SGGS)2_ecTadA_XTEN_nCas9_SGGS_UGI_NLS | (A106V_D108N_D147Y_E155V) + (A106V_D108N_D147Y_E155V) |
| pNMG-293 | pCMV_ecTadA_XTEN_Cas9n_SGGS_NLS | E59A_A106V_D108N_D147Y_E155V |
| pNMG-294 | pCMV_ecTadA_XTEN_Cas9n_SGGS_NLS | E59A |
| pNMG-295 | pCMV_ecTadA_SGGS_NLS (no Cas9 fusion) | E59A |
| pNMG-296 | pCMV_ecTadA_SGGS_NLS (no Cas9 fusion) | E59A cat dead_A106V_D108N_D147Y_E155V |
| pNMG-297 | pCMV_ecTadA-(SGGS)2-XTEN-(SGGS)2_ecTadA_XTEN_nCas9_SGGS_NLS | (A106V_D108N_D147Y_E155V) + (wild-type) |
| pNMG-298 | pCMV_ecTadA-(SGGS)2-XTEN-(SGGS)2_ecTadA_XTEN_nCas9_SGGS_NLS | (D108M_D147Y_E155V) + (D108M_D147Y_E155V) |
| pNMG-320 | pCMV_ecTadA-(SGGS)2-XTEN-(SGGS)2_ecTadA_XTEN_nCas9_SGGS_NLS | (wild-type) + (A106V_D108N_D147Y_E155V) |
| pNMG-321 | pCMV_ecTadA-(SGGS)2-XTEN-(SGGS)2_ecTadA_XTEN_nCas9_SGGS_NLS | (E59A_A106V_D108N_D147Y_E155V) + (A106V_D108N_D147Y_E155V) |
| pNMG-322 | pCMV_ecTadA-(SGGS)2-XTEN-(SGGS)2_ecTadA_XTEN_nCas9_SGGS_NLS | (A106V_D108N_D147Y_E155V) + (E59A_A106V_D108N_D147Y_E155V) |
| pNMG-335 | pCMV_TadA3p-XTEN-TadA2p-XTEN-nCas9-NLS | wild-type |
| pNMG-336 | pCMV_ecTadA-(SGGS)2-XTEN-(SGGS)2_ecTadA_XTEN_nCas9_SGGS_NLS | L84F_A106V_D108N_H123Y_D147Y_E155V_I156Y |
| pNMG-337 | pCMV_ecTadA_SGGS_UGI_SGGS_NLS | A106V_D108N_D147Y_E155V |
| pNMG-338 | pCMV_ecTadA_SGGS_UGI_SGGS_NLS | L84F_A106V_D108N_H123Y_D147Y_E155V_I156F |
| pNMG-339 | pCMV_ecTadA-(SGGS)2-XTEN-(SGGS)2_ecTadA_SGGS_UGI_SGGS_NLS | (L84F_A106V_D108N_H123Y_D147Y_E155V_I156Y) + (L84F_A106V_D108N_H123Y_D147Y_E155V_I156Y) |

TABLE 4-continued

| Name | Construct Architecture | Mutations in TadA |
|---|---|---|
| pNMG-340 | pCMV_ecTadA-(SGGS)2-XTEN-(SGGS)2_ecTadA_(SGGS)2-XTEN-(SGGS)2_nCas9_SGGS_UGI_SGGS_NLS | (A106V_D108N_D147Y_E155V) + (A106V_D108N_D147Y_E155V) |
| pNMG-341 | pCMV_ecTadA-(SGGS)2-XTEN-(SGGS)2_ecTadA_(SGGS)2-XTEN-(SGGS)2_nCas9_SGGS_UGI_SGGS_NLS | (L84F_A106V_D108N_H123Y_D147Y_E155V_I156F) + (L84F_A106V_D108N_H123Y_D147Y_E155V_I156F) |
| pNMG-345 | pCMV_S. aureus TadA-(SGGS)2-XTEN-(SGGS)2-S. aureus TadA-(SGGS)2-XTEN-(SGGS)2-nCas9_SGGS_NLS | wild-type |
| pNMG-346 | pCMV_S. aureus TadA-(SGGS)2-XTEN-(SGGS)2-S. aureus TadA-(SGGS)2-XTEN-(SGGS)2-nCas9_SGGS_NLS | (D108N) + (D108N) |
| pNMG-347 | pCMV_S. aureus TadA-(SGGS)2-XTEN-(SGGS)2-S. aureus TadA-(SGGS)2-XTEN-(SGGS)2-nCas9_SGGS_NLS | (D107A_D018N) + (D107A_D108N) |
| pNMG-348 | pCMV_S. aureus TadA-(SGGS)2-XTEN-(SGGS)2-S. aureus TadA-(SGGS)2-XTEN-(SGGS)2-nCas9_SGGS_NLS | (G26P_D107A_D108N) + (G26P_D107A_D108N) |
| pNMG-349 | pCMV_S. aureus TadA-(SGGS)2-XTEN-(SGGS)2-S. aureus TadA-(SGGS)2-XTEN-(SGGS)2-nCas9 sGGS_NLS | (G26P_D107A_D108N_S142A) + (G26P_D107A_D108N_S142A) |
| pNMG-350 | pCMV_S. aureus TadA-(SGGS)2-XTEN-(SGGS)2-S. aureus TadA-(SGGS)2-XTEN-(SGGS)2-nCas9_SGGS_NLS | (D104A_D108N_S142A) + (D107A_D108N_S142A) |
| pNMG-351 | pCMV_ecTadA-(SGGS)2-XTEN-(SGGS)2_nCas9_SGGS_NLS | (R26G_L84F_A106V_R107H_D108N_H123Y_A142N_A143D_D147Y_E155V_I156F) |
| pNMG-352 | pCMV_ecTadA-(SGGS)2-XTEN-(SGGS)2_nCas9_SGGS_NLS | (E25G_R26G_L84F_A106V_R107H_D108N_H123Y_A142N_A143D_D147Y_E155V_I156F) |
| pNMG-353 | pCMV_ecTadA-(SGGS)2-XTEN-(SGGS)2_nCas9_SGGS_NLS | (E25D_R26G_L84F_A106V_R107K_D108N_H123Y_A142N_A143G_D147Y_E155V_I156F) |
| pNMG-354 | pCMV_ecTadA-(SGGS)2-XTEN-(SGGS)2_nCas9_SGGS_NLS | (R26Q_L84F_A106V_D108N_H123Y_A142N_D147Y_E155V_I156F) |
| pNMG-355 | pCMV_ecTadA-(SGGS)2-XTEN-(SGGS)2_nCas9_SGGS_NLS | (E25M_R26G_L84F_A106V_R107P_D108N_H123Y_A142N_A143D_D147Y_E155V_I156F) |
| pNMG-356 | pCMV_ecTadA-(SGGS)2-XTEN-(SGGS)2_nCas9_SGGS_NLS | (R26C_L84F_A106V_R107H_D108N_H123Y_A142N_A143D_D147Y_E155V_I156F) |
| pNMG-357 | pCMV_ecTadA-(SGGS)2-XTEN-(SGGS)2_nCas9_SGGS_NLS | (L84F_A106V_D108N_H123Y_A142N_A143L_D147Y_E155V_I156F) |
| pNMG-358 | pCMV_ecTadA-(SGGS)2-XTEN-(SGGS)2_nCas9_SGGS_NLS | (R26G_L84F_A106V_D108N_H123Y_A142N_D147Y_E155V_I156F) |
| pNMG-359 | pCMV_ecTadA-(SGGS)2-XTEN-(SGGS)2_nCas9_SGGS_NLS | (E25A_R26G_L84F_A106V_R107H_D108N_H123Y_A142N_A143E_D147Y_E155V_I156F) |
| pNMG-360 | pCMV_ecTadA-(SGGS)2-XTEN-(SGGS)2_nCas9_SGGS_NLS | (R26G_L84F_A106V_R107H_D108N_H123Y_A142N_A143D_D147Y_E155V_I156F) |
| pNMG-361 | pCMV_ecTadA-(SGGS)2-XTEN-(SGGS)2-ecTadA-(SGGS)2-XTEN-(SGGS)2_nCas9_SGGS_NLS | (R26G_L84F_A106V_R107H_D108N_H123Y_A142N_A143D_D147Y_E155V_I156F) x 2 |
| pNMG-362 | pCMV_ecTadA-(SGGS)2-XTEN-(SGGS)2-ecTadA-(SGGS)2-XTEN-(SGGS)2_nCas9_SGGS_NLS | (E25G_R26G_L84F_A106V_R107H_D108N_H123Y_A142N_A143D_D147Y_E155V_I156F) x 2 |
| pNMG-363 | pCMV_ecTadA-(SGGS)2-XTEN-(SGGS)2-ecTadA-(SGGS)2-XTEN-(SGGS)2_nCas9_SGGS_NLS | (R26Q_L84F_A106V_D108N_H123Y_A142N_D147Y_E155V_I156F) x 2 |
| pNMG-364 | pCMV_ecTadA-(SGGS)2-XTEN-(SGGS)2-ecTadA-(SGGS)2-XTEN-(SGGS)2_nCas9_SGGS_NLS | (E25M_R26G_L84F_A106V_R107P_D108N_H123Y_A142N_A143D_D147Y_E155V_I156F) x 2 |
| pNMG-365 | pCMV_ecTadA-(SGGS)2-XTEN-(SGGS)2-ecTadA-(SGGS)2-XTEN-(SGGS)2_nCas9_SGGS_NLS | (R26C_L84F_A106V_R107H_D108N_H123Y_A142N_D147Y_E155V_I156F) x 2 |
| pNMG-366 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_A143L_D147Y_E155V_I156F) x 2 |
| pNMG-367 | pCMV_ecTadA-(SGGS)2-XTEN-(SGGS)2-ecTadA-(SGGS)2-XTEN-(SGGS)2_nCas9_SGGS_NLS | (R26G_L84F_A106V_D108N_H123Y_A142N_D147Y_E155V_I156F) x 2 |
| pNMG-368 | pCMV_ecTadA-(SGGS)2-XTEN-(SGGS)2-ecTadA-(SGGS)2-XTEN-(SGGS)2_nCas9_SGGS_NLS | (E25A_R26G_L84F_A106V_R107H_D108N_H123Y_A142N_A143E_D147Y_E155V_I156Y) |
| pNMG-369 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156Y) + (L84F_A106V_D108N_H123Y_D147Y_E155V_I156Y) |
| pNMG-370 | pCMV_ecTadA-(SGGS)2-XTEN-(SGGS)2-ecTadA-(SGGS)2-XTEN-(SGGS)2_nCas9_SGGS_NLS | (A106V_D108N_D147Y_E155V) + (A106V_D108N_D147Y_E155V) |

TABLE 4-continued

| Name | Construct Architecture | Plasmid Identity Key Mutations in TadA |
|---|---|---|
| pNMG-371 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_D147Y_E155V_I156F) + (L84F_A106V_D108N_H123Y_D147Y_E155V_I156F) |
| pNMG-372 | pCMV_ecTadA_(SGGS)2-XTEN-(SGGS)2_Cas9n_SGGS_NLS | A106V_D108N_A142N_D147Y_E155V |
| pNMG-373 | pCMV_ecTadA_(SGGS)2-XTEN-(SGGS)2_Cas9n_SGGS_NLS | R26G_A106V_D108N_A142N_D147Y_E155V |
| pNMG-374 | pCMV_ecTadA_(SGGS)2-XTEN-(SGGS)2_Cas9n_SGGS_NLS | E25D_R26G_A106V_R107K_D108N_A142N_A143G_D147Y_E155V |
| pNMG-375 | pCMV_ecTadA_(SGGS)2-XTEN-(SGGS)2_Cas9n_SGGS_NLS | R26G_A106V_D108N_R107H_A142N_A143D_D147Y_E155V |
| pNMG-376 | pCMV_ecTadA_(SGGS)2-XTEN-(SGGS)2_Cas9n_SGGS_NLS | E25D_R26G_A106V_D108N_A142N_D147Y_E155V |
| pNMG-377 | pCMV_ecTadA_(SGGS)2-XTEN-(SGGS)2_Cas9n_SGGS_NLS | A106V_R107K_D108N_A142N_D147Y_E155V |
| pNMG-378 | pCMV_ecTadA_(SGGS)2-XTEN-(SGGS)2_Cas9n_SGGS_NLS | A106V_D108N_A142N_A143G_D147Y_E155V |
| pNMG-379 | pCMV_ecTadA_(SGGS)2-XTEN-(SGGS)2_Cas9n_SGGS_NLS | A106V_D108N_A142N_A143L_D147Y_E155V |
| pNMG-382 | pCMV_ecTadA-(SGGS)2-XTEN-(SGGS)2_nCas9_SGGS_NLS | A106V_D108N_A142N_D147Y_E155V x 2 |
| pNMG-383 | pCMV_ecTadA-(SGGS)2-XTEN-(SGGS)2-ecTadA-(SGGS)2-XTEN-(SGGS)2_nCas9_SGGS_NLS | R26G_A106V_D108N_A142N_D147Y_E155V x 2 |
| pNMG-384 | pCMV_ecTadA-(SGGS)2-XTEN-(SGGS)2-ecTadA-(SGGS)2-XTEN-(SGGS)2_nCas9_SGGS_NLS | E25D_R26G_A106V_R107K_D108N_A142N_A143G_D147Y_E155V x 2 |
| pNMG-385 | pCMV_ecTadA-(SGGS)2-XTEN-(SGGS)2-ecTadA-(SGGS)2-XTEN-(SGGS)2_nCas9_SGGS_NLS | R26G_A106V_D108N_R107H_A142N_A143D_D147Y_E155V x 2 |
| pNMG-386 | pCMV_ecTadA-(SGGS)2-XTEN-(SGGS)2-ecTadA-(SGGS)2-XTEN-(SGGS)2_nCas9_SGGS_NLS | E25D_R26G_A106V_D108N_A142N_D147Y_E155V x 2 |
| pNMG-387 | pCMV_ecTadA-(SGGS)2-XTEN-(SGGS)2-ecTadA-(SGGS)2-XTEN-(SGGS)2_nCas9_SGGS_NLS | A106V_R107K_D108N_A142N_D147Y_E155V x 2 |
| pNMG-388 | pCMV_ecTadA-(SGGS)2-XTEN-(SGGS)2-ecTadA-(SGGS)2-XTEN-(SGGS)2_nCas9_SGGS_NLS | A106V_D108N_A142N_A143G_D147Y_E155V x 2 |
| pNMG-389 | pCMV_ecTadA-(SGGS)2-XTEN-(SGGS)2-ecTadA-(SGGS)2-XTEN-(SGGS)2_nCas9_SGGS_NLS | A106V_D108N_A142N_A143L_D147Y_E155V x 2 |
| pNMG-391 | pCMV_ecTadA_(SGGS)2-XTEN-(SGGS)2_Cas9n_SGGS_UGI_SGGS_NLS | H36L_R51L_L84F_A106V_D108N_H123Y_S146C_D147Y_E155V_I156F_K157N |
| pNMG-392 | pCMV_ecTadA_(SGGS)2-XTEN-(SGGS)2_Cas9n_SGGS_UGI_SGGS_NLS | N37T_P48T_M70L_L84F_A106V_D108N_H123Y_D147Y_E155V_I49V_E155V_I156F |
| pNMG-393 | pCMV_ecTadA_(SGGS)2-XTEN-(SGGS)2_Cas9n_SGGS_UGI_SGGS_NLS | N37S_L84F_A106V_D108N_H123Y_D147Y_E155V_I156F_K161T |
| pNMG-394 | pCMV_ecTadA_(SGGS)2-XTEN-(SGGS)2_Cas9n_SGGS_UGI_SGGS_NLS | L36L_L84F_A106V_D108N_H123Y_D147Y_Q154H_E155V_I156F |
| pNMG-395 | pCMV_ecTadA_(SGGS)2-XTEN-(SGGS)2_Cas9n_SGGS_UGI_SGGS_NLS | N72S_L84F_A106V_D108N_H123Y_S146R_D147Y_E155V_I156F |
| pNMG-396 | pCMV_ecTadA_(SGGS)2-XTEN-(SGGS)2_Cas9n_SGGS_UGI_SGGS_NLS | H36L_P48L_L84F_A106V_D108N_H123Y_E134G_D147Y_E155V_I156F |
| pNMG-397 | pCMV_ecTadA_(SGGS)2-XTEN-(SGGS)2_Cas9n_SGGS_UGI_SGGS_NLS | H36L_L84F_A106V_D108N_H123Y_D147Y_E155V_I156F_K157N |
| pNMG-398 | pCMV_ecTadA_(SGGS)2-XTEN-(SGGS)2_Cas9n_SGGS_UGI_SGGS_NLS | H36L_L84F_A106V_D108N_H123Y_S146C_D147Y_E155V_I156F |
| pNMG-399 | pCMV_ecTadA_(SGGS)2-XTEN-(SGGS)2_Cas9n_SGGS_UGI_SGGS_NLS | L84F_A106V_D108N_H123Y_S146R_D147Y_E155V_I156F_K161T |
| pNMG-400 | pCMV_ecTadA_(SGGS)2-XTEN-(SGGS)2_Cas9n_SGGS_UGI_SGGS_NLS | N37S_R51H_D77G_L84F_A106V_D108N_H123Y_D147Y_E155V_I156F |
| pNMG-401 | pCMV_ecTadA_(SGGS)2-XTEN-(SGGS)2_Cas9n_SGGS_UGI_SGGS_NLS | R51L_L84F_A106V_D108N_H123Y_D147Y_E155V_I156F_K157N |

TABLE 4-continued

| Name | Construct Architecture | Mutations in TadA |
|---|---|---|
| pNMG-402 | pCMV_ecTadA-(SGGS)2-XTEN-(SGGS)2-ecTadA-(SGGS)2-XTEN-(SGGS)2_nCas9_SGGS_NLS | (H36L_R51L_L84F_A106V_D108N_H123Y_S146C_D147Y_E155V_I156F_K157N) × 2 |
| pNMG-403 | pCMV_ecTadA-(SGGS)2-XTEN-(SGGS)2-ecTadA-(SGGS)2-XTEN-(SGGS)2_nCas9_SGGS_NLS | (N37T_P48T_M70L_L84F_A106V_D108N_H123Y_D147Y_I49V_E155V_I156F) × 2 |
| pNMG-404 | pCMV_ecTadA-(SGGS)2-XTEN-(SGGS)2-ecTadA-(SGGS)2-XTEN-(SGGS)2_nCas9_SGGS_NLS | (N37S_L84F_A106V_D108N_H123Y_D147Y_E155V_I156F_K161T) × 2 |
| pNMG-405 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_D147Y_Q154H_E155V_I156F) × 2 |
| pNMG-406 | pCMV_ecTadA-(SGGS)2-XTEN-(SGGS)2-ecTadA-(SGGS)2-XTEN-(SGGS)2_nCas9_SGGS_NLS | (N72S_L84F_A106V_D108N_H123Y_S146R_D147Y_E155V_I156F) × 2 |
| pNMG-407 | pCMV_ecTadA-(SGGS)2-XTEN-(SGGS)2-ecTadA-(SGGS)2-XTEN-(SGGS)2_nCas9_SGGS_NLS | (H36L_P48L_L84F_A106V_D108N_H123Y_E134G_D147Y_E155V_I156F) × 2 |
| pNMG-408 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_D147Y_E155V_I156F_K157N) × 2 |
| pNMG-409 | pCMV_ecTadA-(SGGS)2-XTEN-(SGGS)2-ecTadA-(SGGS)2-XTEN-(SGGS)2_nCas9_SGGS_NLS | (H36L_L84F_A106V_D108N_H123Y_S146C_D147Y_E155V_I156F) × 2 |
| pNMG-410 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_S146R_D147Y_E155V_I156F_K161T) × 2 |
| pNMG-411 | pCMV_ecTadA-(SGGS)2-XTEN-(SGGS)2-ecTadA-(SGGS)2-XTEN-(SGGS)2_nCas9_SGGS_NLS | (N37S_R51H_D77G_L84F_A106V_D108N_H123Y_D147Y_E155V_I156F) × 2 |
| pNMG-412 | pCMV_ecTadA-(SGGS)2-XTEN-(SGGS)2-ecTadA-(SGGS)2-XTEN-(SGGS)2_nCas9_SGGS_NLS | (R51L_L84F_A106V_D108N_H123Y_D147Y_E155V_I156F_K157N) × 2 |
| pNMG-440 | pCMV_ecTadA-(SGGS)2-XTEN-(SGGS)2_Cas9n_SGGS_UGI_SGGS_NLS | D24G_Q71R_L84F_H96L_A106V_D108N_H123Y_D147Y_E155V_I156F_K160E |
| pNMG-441 | pCMV_ecTadA-(SGGS)2-XTEN-(SGGS)2_Cas9n_SGGS_UGI_SGGS_NLS | H36L_G67V_L84F_A106V_D108N_H123Y_S146T_D147Y_E155V_I156F |
| pNMG-442 | pCMV_ecTadA-(SGGS)2-XTEN-(SGGS)2_Cas9n_SGGS_UGI_SGGS_NLS | Q71L_L84F_A106V_D108N_H123Y_L137M_A143E_D147Y_E155V_I156F |
| pNMG-443 | pCMV_ecTadA-(SGGS)2-XTEN-(SGGS)2_Cas9n_SGGS_UGI_SGGS_NLS | E25G_L84F_A106V_D108N_H123Y_D147Y_E155V_I156F_Q159L |
| pNMG-444 | pCMV_ecTadA-(SGGS)2-XTEN-(SGGS)2_Cas9n_SGGS_UGI_SGGS_NLS | L84F_A91T_F104L_A106V_D108N_H123Y_D147Y_E155V_I156F |
| pNMG-445 | pCMV_ecTadA-(SGGS)2-XTEN-(SGGS)2_Cas9n_SGGS_UGI_SGGS_NLS | N72D_L84F_A106V_D108N_H123Y_G125A_D147Y_E155V_I156F |
| pNMG-446 | pCMV_ecTadA-(SGGS)2-XTEN-(SGGS)2_Cas9n_SGGS_UGI_SGGS_NLS | P48S_L84F_S97C_A106V_D108N_H123Y_D147Y_E155V_I156F |
| pNMG-447 | pCMV_ecTadA-(SGGS)2-XTEN-(SGGS)2_Cas9n_SGGS_UGI_SGGS_NLS | W23G_L84F_A106V_D108N_H123Y_D147Y_E155V_I156F |
| pNMG-448 | pCMV_ecTadA-(SGGS)2-XTEN-(SGGS)2_Cas9n_SGGS_UGI_SGGS_NLS | D24G_P48L_Q71R_L84F_H96L_A106V_D108N_H123Y_D147Y_E155V_I156F_Q159L |
| pNMG-449 | pCMV_ecTadA-(SGGS)2-XTEN-(SGGS)2-ecTadA-(SGGS)2-XTEN-(SGGS)2_nCas9_SGGS_NLS | (D24G_Q71R_L84F_H96L_A106V_D108N_H123Y_D147Y_E155V_I156F_K160E) × 2 |
| pNMG-450 | pCMV_ecTadA-(SGGS)2-XTEN-(SGGS)2-ecTadA-(SGGS)2-XTEN-(SGGS)2_nCas9_SGGS_NLS | (H36L_G67V_L84F_A106V_D108N_H123Y_S146T_D147Y_E155V_I156F) × 2 |
| pNMG-451 | pCMV_ecTadA-(SGGS)2-XTEN-(SGGS)2-ecTadA-(SGGS)2-XTEN-(SGGS)2_nCas9_SGGS_NLS | (Q71L_L84F_A106V_D108N_H123Y_L137M_A143E_D147Y_E155V_I156F) × 2 |
| pNMG-452 | pCMV_ecTadA-(SGGS)2-XTEN-(SGGS)2-ecTadA-(SGGS)2-XTEN-(SGGS)2_nCas9_SGGS_NLS | (E25G_L84F_A106V_D108N_H123Y_D147Y_E155V_I156F_Q159L) × 2 |

TABLE 4-continued

| Name | Construct Architecture | Mutations in TadA |
|---|---|---|
| pNMG-453 | pCMV_ecTadA-(SGGS)2-XTEN-(SGGS)2-ecTadA-(SGGS)2-XTEN-(SGGS)2_nCas9_SGGS_NLS | (L84F_A91T_F104I_A106V_D108N_H123Y_D147Y_E155V_I156F) × 2 |
| pNMG-454 | pCMV_ecTadA-(SGGS)2-XTEN-(SGGS)2-ecTadA-(SGGS)2-XTEN-(SGGS)2_nCas9_SGGS_NLS | (N72D_L84F_A106V_D108N_H123Y_G125A_D147Y_E155V_I156F) × 2 |
| pNMG-455 | pCMV_ecTadA-(SGGS)2-XTEN-(SGGS)2-ecTadA-(SGGS)2-XTEN-(SGGS)2_nCas9_SGGS_NLS | (P48S_L84F_S97C_A106V_D108N_H123Y_D147Y_E155V_I156F) × 2 |
| pNMG-456 | pCMV_ecTadA-(SGGS)2-XTEN-(SGGS)2-ecTadA-(SGGS)2-XTEN-(SGGS)2_nCas9_SGGS_NLS | (W23G_L84F_A106V_D108N_H123Y_D147Y_E155V_I156F) × 2 |
| pNMG-457 | pCMV_ecTadA-(SGGS)2-XTEN-(SGGS)2-ecTadA-(SGGS)2-XTEN-(SGGS)2_nCas9_SGGS_NLS | (D24G_P48L_Q71R_L84F_A106V_D108N_H123Y_D147Y_E155V_I156F_Q159L) × 2 |
| pNMG-473 | pCMV_ecTadA_(SGGS)2-XTEN-(SGGS)2_Cas9n_SGGS_UGI_SGGS_NLS | L84F_A106V_D108N_H123Y_A142N_D147Y_E155V_I156F |
| pNMG-474 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A142N_D147Y_E155V_I156F) × 2 |
| pNMG-475 | pCMV_ecTadA-(SGGS)2-XTEN-(SGGS)2-ecTadA-(SGGS)2-XTEN-(SGGS)2_nCas9_SGGS_NLS | (wild-type) + (A106V_D108N_D147Y_E155V) |
| pNMG-476 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_D147Y_E155V_I156F) |
| pNMG-477 | pCMV_ecTadA-(SGGS)2-XTEN-(SGGS)2-ecTadA-(SGGS)2-XTEN-(SGGS)2_nCas9_SGGS_NLS | (wild-type) + (H36L_R51L_L84F_A106V_D108N_H123Y_S146C_D147Y_E155V_I156F_K161T) |
| pNMG-478 | pCMV_ecTadA-(SGGS)2-XTEN-(SGGS)2-ecTadA-(SGGS)2-XTEN-(SGGS)2_nCas9_SGGS_NLS | (wild-type) + (N37S_L84F_A106V_D108N_H123Y_D147Y_E155V_I156F_K161T) |
| pNMG-479 | pCMV_ecTadA-(SGGS)2-XTEN-(SGGS)2-ecTadA-(SGGS)2-XTEN-(SGGS)2_nCas9_SGGS_NLS | (wild-type) + (L84F_A106V_D108N_H123Y_S146R_D147Y_E155V_I156F_K161T) |
| pNMG-480 | pCMV_ecTadA_(SGGS)2-XTEN-(SGGS)2_Cas9n_SGGS_NLS | wild-type |
| pNMG-481 | pCMV_ecTadA_(SGGS)2-XTEN-(SGGS)2_Cas9n_SGGS_NLS | A106V_D108N |
| pNMG-482 | pCMV_ecTadA-(SGGS)2-XTEN-(SGGS)2-ecTadA-(SGGS)2-XTEN-(SGGS)2_nCas9_SGGS_NLS | wild-type + wild-type |
| pNMG-483 | pCMV_ecTadA-(SGGS)2-XTEN-(SGGS)2-ecTadA-(SGGS)2-XTEN-(SGGS)2_nCas9_SGGS_NLS | (A106V_D108N) × 2 |
| pNMG-484 | pCMV_ecTadA-(SGGS)2-XTEN-(SGGS)2-ecTadA-(SGGS)2-XTEN-(SGGS)2_nCas9_SGGS_NLS | (wild-type) + (A106V_D108N) |
| pNMG-485 | pCMV_ecTadA_(SGGS)2-XTEN-(SGGS)2_Cas9n_SGGS_UGI_SGGS_NLS | H36L_R51L_L84F_A106V_D108N_H123Y_A142N_S146C_D147Y_E155V_I156F_K157N |
| pNMG-486 | pCMV_ecTadA_(SGGS)2-XTEN-(SGGS)2_Cas9n_SGGS_UGI_SGGS_NLS | N37S_L84F_A106V_D108N_H123Y_A142N_D147Y_E155V_I156F_K161T |
| pNMG-487 | pCMV_ecTadA_(SGGS)2-XTEN-(SGGS)2_Cas9n_SGGS_UGI_SGGS_NLS | L84F_A106V_D108N_D147Y_E155V_I156F |
| pNMG-488 | pCMV_ecTadA_(SGGS)2-XTEN-(SGGS)2_Cas9n_SGGS_UGI_SGGS_NLS | R51L_L84F_A106V_D108N_H123Y_S146C_D147Y_E155V_I156F_K161T |
| pNMG-489 | pCMV_ecTadA_(SGGS)2-XTEN-(SGGS)2_Cas9n_SGGS_UGI_SGGS_NLS | L84F_A106V_D108N_H123Y_S146C_D147Y_E155V_I156F_K161T |
| pNMG-490 | pCMV_ecTadA_(SGGS)2-XTEN-(SGGS)2_Cas9n_SGGS_UGI_SGGS_NLS | L84F_A106V_D108N_H123Y_S146C_D147Y_E155V_I156F_K157N_K160E_K161T |
| pNMG-491 | pCMV_ecTadA_(SGGS)2-XTEN-(SGGS)2_Cas9n_SGGS_UGI_SGGS_NLS | L84F_A106V_D108N_H123Y_S146C_D147Y_E155V_I156F_K157N_K160E |
| pNMG-492 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_A142N_D147Y_E155V_I156F) |

TABLE 4-continued

| Name | Construct Architecture | Mutations in TadA |
|---|---|---|
| pNMG-493 | pCMV_ecTadA-(SGGS)2-XTEN-(SGGS)2-ecTadA-(SGGS)2-XTEN-(SGGS)2_nCas9_SGGS_NLS | (wt) + (D24G_Q71R_L84F_H96L_A106V_D108N_H123Y_D147Y_E155V_I156F_K160E) |
| pNMG-494 | pCMV_ecTadA-(SGGS)2-XTEN-(SGGS)2-ecTadA-(SGGS)2-XTEN-(SGGS)2_nCas9_SGGS_NLS | (wt) + (H36L_R51L_L84F_A106V_D108N_H123Y_A142N_S146C_D147Y_E155V_I156F_K157N) |
| pNMG-495 | pCMV_ecTadA-(SGGS)2-XTEN-(SGGS)2-ecTadA-(SGGS)2-XTEN-(SGGS)2_nCas9_SGGS_NLS | (wt) + (N37S_L84F_A106V_D108N_H123Y_A142N_D147Y_E155V_I156F_K161T) |
| pNMG-496 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_D147Y_E155V_I156F) |
| pNMG-497 | pCMV_ecTadA-(SGGS)2-XTEN-(SGGS)2-ecTadA-(SGGS)2-XTEN-(SGGS)2_nCas9_SGGS_NLS | (wt) + (R51L_L84F_A106V_D108N_H123Y_S146C_D147Y_E155V_I156F_K161T) |
| pNMG-498 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K161T) |
| pNMG-499 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K160E_K161T) |
| pNMG-500 | pCMV_ecTadA-(SGGS)2-XTEN-(SGGS)2-ecTadA-(SGGS)2-XTEN-(SGGS)2_nCas9_SGGS_NLS | (wt) + (L84F_A106V_D108N_H123Y_S146C_D147Y_E155V_I156F_K157N_K160E) |
| pNMG-513 | pCMV_ecTadA-92 a.a.-ecTadA-32 a.a._nCas9_SGGS_NLS | (wt) + (L84F_A106V_D108N_H123Y_D147Y_E155V_I156F) |
| pNMG-514 | pCMV_ecTadA-92 a.a.-ecTadA-32 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-515 | pCMV_ecTadA-92 a.a.-ecTadA-32 a.a._nCas9_SGGS_NLS | (L84F_A106V_D108N_H123Y_D147Y_E155V_I156F) |
| pNMG-516 | pCMV_ecTadA-92 a.a.-ecTadA-64 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-517 | pCMV_ecTadA-32 a.a.-ecTadA-64 a.a._nCas9_SGGS_NLS | (wt) + (L84F_A106V_D108N_H123Y_D147Y_E155V_I156F) |
| pNMG-518 | pCMV_ecTadA-32 a.a.-ecTadA-64 a.a._nCas9_SGGS_NLS | (L84F_A106V_D108N_H123Y_D147Y_E155V_I156F) + (L84F_A106V_D108N_H123Y_D147Y_E155V_I156F) |
| pNMG-519 | pCMV_ecTadA-32 a.a._nCas9_SGGS_NLS | R74Q |
| pNMG-520 | pCMV_ecTadA-32 a.a._nCas9_SGGS_NLS | R74Q |
| pNMG-521 | pCMV_ecTadA-(SGGS)2-XTEN-(SGGS)2_nCas9_SGGS_NLS | L84F_A106V_D108N_H123Y_D147Y_E155V_I156F |
| pNMG-522 | pCMV_ecTadA-(SGGS)2-XTEN-(SGGS)2_nCas9_SGGS_NLS | R74A_L84F_A106V_D108N_H123Y_D147Y_E155V_I156F |
| pNMG-523 | pCMV_ecTadA-(SGGS)2-XTEN-(SGGS)2_nCas9_SGGS_NLS | R98Q |
| pNMG-524 | pCMV_ecTadA-(SGGS)2-XTEN-(SGGS)2_nCas9_SGGS_NLS | R129Q |
| pNMG-525 | pCMV_ecTadA-(SGGS)2-XTEN-(SGGS)2-ecTadA-(SGGS)2-XTEN-(SGGS)2_nCas9_SGGS_NLS | (wt + R74Q) + (L84F_A106V_D108N_H123Y_D147Y_E155V_I156F) |
| pNMG-526 | pCMV_ecTadA-(SGGS)2-XTEN-(SGGS)2-ecTadA-(SGGS)2-XTEN-(SGGS)2_nCas9_SGGS_NLS | (wt + R74Q) + (R74Q_L84F_A106V_D108N_H123Y_D147Y_E155V_I156F) |
| pNMG-527 | pCMV_ecTadA-(SGGS)2-XTEN-(SGGS)2-ecTadA-(SGGS)2-XTEN-(SGGS)2_nCas9_SGGS_NLS | (R74A_L84F_A106V_D108N_H123Y_D147Y_E155V_I156F) + (R74A_L84F_A106V_D108N_H123Y_D147Y_E155V_I156F) |
| pNMG-528 | pCMV_ecTadA-(SGGS)2-XTEN-(SGGS)2-ecTadA-(SGGS)2-XTEN-(SGGS)2_nCas9_SGGS_NLS | (wt + R98Q) + (L84F_R98Q_A106V_D108N_H123Y_D147Y_E155V_I156F) |
| pNMG-529 | pCMV_ecTadA-(SGGS)2-XTEN-(SGGS)2-ecTadA-(SGGS)2-XTEN-(SGGS)2_nCas9_SGGS_NLS | (wt + R129Q) + (L84F_A106V_D108N_H123Y_R129Q_D147Y_E155V_I156F) |
| pNMG-530 | pCMV_ecTadA-(SGGS)2-XTEN-(SGGS)2-ecTadA-(SGGS)2-XTEN-(SGGS)2_nCas9_SGGS_NLS | (L84F_A106V_D108N_H123Y_A106V_D108N_H123Y_S146C_D147Y_E155V_I156F) + (H36L_R51L_L84F_A106V_D108N_H123Y_S146C_D147Y_E155V_I156F_K157N) |
| pNMG-543 | pCMV_ecTadA-(SGGS)2-XTEN-(SGGS)2_nCas9_SGGS_NLS | (P48S_L84F_A106V_D108N_H123Y_A142N_D147Y_E155V_I156F) |

TABLE 4-continued

| Name | Construct Architecture | Mutations in TadA (Plasmid Identity Key) |
|---|---|---|
| pNMG-544 | pCMV_ecTadA-(SGGS)2-XTEN-(SGGS)2_nCas9_SGGS_NLS | (P48T_I49V_L84F_A106V_D108N_H123Y_A142N_D147Y_E155V_I156F_L157N) |
| pNMG-545 | pCMV_ecTadA-(SGGS)2-XTEN-(SGGS)2_nCas9_SGGS_NLS | P48S_A142N |
| pNMG-546 | pCMV_ecTadA-(SGGS)2-XTEN-(SGGS)2_nCas9_SGGS_NLS | P48T_I49V_A142N |
| pNMG-547 | pCMV_ecTadA-(SGGS)2-XTEN-(SGGS)2-ecTadA-(SGGS)2-XTEN-(SGGS)2_nCas9_SGGS_NLS | (wt) + (P48S_L84F_A106V_D108N_H123Y_A142N_D147Y_E155V_I156F) |
| pNMG-548 | pCMV_ecTadA-(SGGS)2-XTEN-(SGGS)2-ecTadA-(SGGS)2-XTEN-(SGGS)2_nCas9_SGGS_NLS | (P48S_L84F_A106V_D108N_H123Y_A142N_D147Y_E155V_I156F) + (P48S_L84F_A106V_D108N_H123Y_A142N_D147Y_E155V_I156F) |
| pNMG-549 | pCMV_ecTadA-(SGGS)2-XTEN-(SGGS)2-ecTadA-(SGGS)2-XTEN-(SGGS)2_nCas9_SGGS_NLS | (P48S_A142N) + (P48S_L84F_A106V_D108N_H123Y_A142N_D147Y_E155V_I156F) |
| pNMG-550 | pCMV_ecTadA-(SGGS)2-XTEN-(SGGS)2-ecTadA-(SGGS)2-XTEN-(SGGS)2_nCas9_SGGS_NLS | (P48S_A142N) + (L84F_A106V_D108N_H123Y_D147Y_E155V_I156F) |
| pNMG-551 | pCMV_ecTadA-(SGGS)2-XTEN-(SGGS)2-ecTadA-(SGGS)2-XTEN-(SGGS)2_nCas9_SGGS_NLS | (wt) + (P48T_I49V_L84F_A106V_D108N_H123Y_A142N_D147Y_E155V_I156F_L157N) |
| pNMG-552 | pCMV_ecTadA-(SGGS)2-XTEN-(SGGS)2-ecTadA-(SGGS)2-XTEN-(SGGS)2_nCas9_SGGS_NLS | (P48T_I49V_L84F_A106V_D108N_H123Y_A142N_D147Y_E155V_I156F_L157N) + (P48T_I49V_L84F_A106V_D108N_H123Y_A142N_D147Y_E155V_I156F_L157N) |
| pNMG-553 | pCMV_ecTadA-(SGGS)2-XTEN-(SGGS)2-ecTadA-(SGGS)2-XTEN-(SGGS)2_nCas9_SGGS_NLS | (P48T_I49V_A142N) + (P48T_I49V_L84F_A106V_D108N_H123Y_A142N_D147Y_E155V_I156F_L157N) |
| pNMG-554 | pCMV_ecTadA-(SGGS)2-XTEN-(SGGS)2-ecTadA-(SGGS)2-XTEN-(SGGS)2_nCas9_SGGS_NLS | (P48T_I49V_A142N) + (L84F_A106V_D108N_H123Y_D147Y_E155V_I156F) |
| pNMG-555 | pCMV_ecTadA-24 a.a.linker-ecTadA-24 a.a.linker_nCas9_SGGS_NLS | (wt) + (H36L_R51L_L84F_A106V_D108N_H123Y_S146C_D147Y_E155V_I156F_K157N) |
| pNMG-556 | pCMV_ecTadA-24 a.a.linker-ecTadA-32 a.a.linker_nCas9_SGGS_NLS | (wt) + (H36L_R51L_L84F_A106V_D108N_H123Y_S146C_D147Y_E155V_I156F_K157N) |
| pNMG-557 | pCMV_ecTadA-24 a.a.linker-ecTadA-40 a.a.linker_nCas9_SGGS_NLS | (wt) + (H36L_R51L_L84F_A106V_D108N_H123Y_S146C_D147Y_E155V_I156F_K157N) |
| pNMG-558 | pCMV_ecTadA-32 a.a.linker-ecTadA-24 a.a.linker_nCas9_SGGS_NLS | (wt) + (H36L_R51L_L84F_A106V_D108N_H123Y_S146C_D147Y_E155V_I156F_K157N) |
| pNMG-559 | pCMV_ecTadA-32 a.a.linker-ecTadA-40 a.a.linker_nCas9_SGGS_NLS | (wt) + (H36L_R51L_L84F_A106V_D108N_H123Y_S146C_D147Y_E155V_I156F_K157N) |
| pNMG-560 | pCMV_ecTadA-40 a.a.linker-ecTadA-24 a.a.linker_nCas9_SGGS_NLS | (wt) + (H36L_R51L_L84F_A106V_D108N_H123Y_S146C_D147Y_E155V_I156F_K157N) |
| pNMG-561 | pCMV_ecTadA-40 a.a.linker-ecTadA-32 a.a.linker_nCas9_SGGS_NLS | (wt) + (H36L_R51L_L84F_A106V_D108N_H123Y_S146C_D147Y_E155V_I156F_K157N) |
| pNMG-562 | pCMV_ecTadA-40 a.a.linker-ecTadA-40 a.a.linker_nCas9_SGGS_NLS | (wt) + (H36L_R51L_L84F_A106V_D108N_H123Y_S146C_D147Y_E155V_I156F_K157N) |
| pNMG-563 | pCMV_ecTadA-(SGGS)2-XTEN-(SGGS)2_nCas9_XTEN_nCas9_SGGS_NLS | wild-type |
| pNMG-564 | pCMV_ecTadA-(SGGS)2-XTEN-(SGGS)2_nCas9_XTEN_nCas9_SGGS_NLS | (H36L_R51L_L84F_A106V_D108N_H123Y_S146C_D147Y_E155V_I156F_K157N) |
| pNMG-565 | pCMV_ecTadA-(SGGS)2-XTEN-(SGGS)2_nCas9_XTEN_MBD4_SGGS_NLS | (wt) + (H36L_R51L_L84F_A106V_D108N_H123Y_S146C_D147Y_E155V_I156F_K157N) |
| pNMG-566 | pCMV_ecTadA-(SGGS)2-XTEN-(SGGS)2_nCas9_XTEN_TDG_SGGS_NLS | (wt) + (H36L_R51L_L84F_A106V_D108N_H123Y_S146C_D147Y_E155V_I156F_K157N) |
| pNMG-572 | pCMV_ecTadA-32 a.a.-_nCas9_SGGS_NLS | (H36L_R51L_P48S_R51L_L84F_A106V_D108N_H123Y_S146C_D147Y_E155V_I156F_K157N) |
| pNMG-573 | pCMV_ecTadA-32 a.a.-_nCas9_SGGS_NLS | (H36L_P48S_R51L_L84F_A106V_D108N_H123Y_S146C_A142N_D147Y_E155V_I156F_K157N) |
| pNMG-574 | pCMV_ecTadA-32 a.a.-_nCas9_SGGS_NLS | (H36L_P48T_I49V_R51L_L84F_A106V_D108N_H123Y_S146C_D147Y_E155V_I156F_K157N) |
| pNMG-575 | pCMV_ecTadA-32 a.a.-_nCas9_SGGS_NLS | (H36L_P48T_I49V_R51L_L84F_A106V_D108N_H123Y_A142N_S146C_D147Y_E155V_I156F_K157N) |
| pNMG-576 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_D147Y_E155V_I156F_K157N) |
| pNMG-577 | pCMV_ecTadA-(SGGS)2-XTEN-(SGGS)2-ecTadA-(SGGS)2-XTEN-(SGGS)2_nCas9_SGGS_NLS | (wt) + (H36L_P48S_R51L_L84F_A106V_D108N_H123Y_S146C_A142N_D147Y_E155V_I156F_K157N) |

TABLE 4-continued

Plasmid Identity Key

| Name | Construct Architecture | Mutations in TadA |
|---|---|---|
| pNMG-578 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_S146C_D147Y_E155V_I156F_K157N) |
| pNMG-579 | pCMV_ecTadA-(SGGS)2-XTEN-(SGGS)2-ecTadA-(SGGS)2-XTEN-(SGGS)2_nCas9_SGGS_NLS | (wt) + (H36L_P48T_I49V_R51L_L84F_A106V_D108N_H123Y_A142N_S146C_D147Y_E155V_I156F_K157N) |
| pNMG-580 | pCMV_ecTadA-(SGGS)2-XTEN-(SGGS)2-ecTadA-(SGGS)2-XTEN-(SGGS)2_nCas9_SGGS_NLS | (H36L_P48S_R51L_L84F_A106V_D108N_H123Y_S146C_D147Y_E155V_I156F_K157N) + |
| pNMG-581 | pCMV_ecTadA-32 a.a.-_nCas9_SGGS_NLS | (H36L_P48S_R51L_L84F_A106V_D108N_H123Y_S146C_D147Y_E155V_I156F_K157N) |
| pNMG-583 | pCMV_ecTadA-32 a.a.-_nCas9_SGGS_NLS | (H36L_P48A_R51L_L84F_A106V_D108N_H123Y_S146C_D147Y_E155V_I156F_K157N) |
| pNMG-586 | pCMV_ecTadA-(SGGS)2-XTEN-(SGGS)2-ecTadA-(SGGS)2-XTEN-(SGGS)2_nCas9_SGGS_NLS | (H36L_P48A_R51L_L84F_A106V_D108N_H123Y_A142N_S146C_D147Y_E155V_I156F_K157N) |
| pNMG-588 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_A142N_D147Y_E155V_I156F_K157N) |
| pNMG-603 | pCMV_ecTadA-32 a.a.-_nCas9_SGGS_NLS | (W23L_H36L_P48A_R51L_L84F_A106V_D108N_H123Y_S146C_D147Y_E155V_I156F_K157N) |
| pNMG-604 | pCMV_ecTadA-32 a.a.-_nCas9_SGGS_NLS | (W23R_H36L_P48A_R51L_L84F_A106V_D108N_H123Y_S146C_D147Y_E155V_I156F_K157N) |
| pNMG-605 | pCMV_ecTadA-32 a.a.-_nCas9_SGGS_NLS | (W23L_H36L_P48A_R51L_L84F_A106V_D108N_H123Y_S146C_D147Y_E155V_I156F_K161T) |
| pNMG-606 | pCMV_ecTadA-32 a.a.-_nCas9_SGGS_NLS | (W23L_H36L_P48A_R51L_L84F_A106V_D108N_H123Y_S146R_D147Y_E155V_I156F_K161T) |
| pNMG-607 | pCMV_ecTadA-32 a.a.-_nCas9_SGGS_NLS | (H36L_P48A_R51L_L84F_A106V_D108N_H123Y_S146C_D147Y_R152H_E155V_I156F_K157N) |
| pNMG-608 | pCMV_ecTadA-32 a.a.-_nCas9_SGGS_NLS | (H36L_P48A_R51L_L84F_A106V_D108N_H123Y_S146C_D147Y_R152P_E155V_I156F_K157N) |
| pNMG-609 | pCMV_ecTadA-32 a.a.-_nCas9_SGGS_NLS | (W23L_H36L_P48A_R51L_L84F_A106V_D108N_H123Y_S146C_D147Y_R152P_E155V_I156F_K157N) |
| pNMG-610 | pCMV_ecTadA-32 a.a.-_nCas9_SGGS_NLS | (W23L_H36L_P48A_R51L_L84F_A106V_D108N_H123Y_A142N_S146C_D147Y_R152P_E155V_I156F_K157N) |
| pNMG-611 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_E155V_I156F_K157N) |
| pNMG-612 | pCMV_ecTadA-(SGGS)2-XTEN-(SGGS)2-ecTadA-(SGGS)2-XTEN-(SGGS)2_nCas9_SGGS_NLS | (wt) + (W23R_H36L_P48A_R51L_L84F_A106V_D108N_H123Y_S146C_D147Y_E155V_I156F_K157N) |
| pNMG-613 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146R_D147Y_E155V_I156F_K161T) |
| pNMG-614 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_R152H_E155V_I156F_K157N) |
| pNMG-615 | pCMV_ecTadA-(SGGS)2-XTEN-(SGGS)2-ecTadA-(SGGS)2-XTEN-(SGGS)2_nCas9_SGGS_NLS | (wt) + (H36L_P48A_R51L_L84F_A106V_D108N_H123Y_S146C_D147Y_R152P_E155V_I156F_K157N) |
| pNMG-616 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_S146C_D147Y_R152P_E155V_I156F_K157N) |
| pNMG-617 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_A142A_S146C_D147Y_E155V_I156F_K157N) |
| pNMG-618 | pCMV_ecTadA-(SGGS)2-XTEN-(SGGS)2-ecTadA-(SGGS)2-XTEN-(SGGS)2_nCas9_SGGS_NLS | (wt) + (W23L_H36L_P48A_R51L_L84F_A106V_D108N_H123Y_A142A_S146C_D147Y_R152P_E155V_I156F_K157N) |
| pNMG-619 | pCMV_ecTadA-32 a.a.-_nCas9_SGGS_NLS | (W23R_H36L_P48A_R51L_L84F_A106V_D108N_H123Y_S146C_D147Y_R152P_E155V_I156F_K157N) |
| pNMG-620 | pCMV_ecTadA-32 a.a.-_nCas9_SGGS_NLS | (W23R_H36L_P48A_R51L_L84F_A106V_D108N_H123Y_A142N_S146C_D147Y_R152P_E155V_I156F_K157N) |
| pNMG-621 | pCMV_ecTadA-32 a.a.linker-ecTadA-24 a.a. linker_nCas9_SGGS_NLS | (wt) + (H36L_P48A_R51L_L84F_A106V_D108N_H123Y_S146C_D147Y_E155V_I156F_K157N) |
| pNMG-622 | pCMV_ecTadA-32 a.a.linker-ecTadA-24 a.a. linker_nCas9_SGGS_NLS | (wt) + (H36L_P48A_R51L_L84F_A106V_D108N_H123Y_A142N_S146C_D147Y_E155V_I156F_K157N) |
| pNMG-623 | pCMV_ecTadA-32 a.a.linker-ecTadA-24 a.a. linker_nCas9_SGGS_NLS | (wt) + (W23L_H36L_P48A_R51L_L84F_A106V_D108N_H123Y_S146C_D147Y_R152P_E155V_I156F_K157N) |
| pNMG-624 | pCMV_ecTadA-32 a.a.linker-ecTadA-24 a.a. linker_nCas9_SGGS_NLS | (wt) + (W23R_H36L_P48A_R51L_L84F_A106V_D108N_H123Y_S146C_D147Y_R152P_E155V_I156F_K157N) |

Example 2—Evolution of Adenosine Base Editor Containing the D108N Mutation of ecTadA (Evolution #2)

An ecTadA construct with a D108N (pNMG-128) mutation was mutagenized via error-prone PCR, as in Evolution #1, and this library was selected against the same chloramphenicol site, except higher concentrations of chloramphenicol was used in the selection media to increase the stringency of the selection. This round of selection produced two new mutations which improved the editing efficiencies of ABE: D147Y and E155V.

In the first round of evolution, error-prone PCR was conducted on the ecTadA deaminase portion of a ecTadA-XTEN-dCas9 fusion construct followed by USER assembly to create a library of ecTadA-XTEN-dCas9 variants (varied only in the deaminase portion). These library members were transformed into S1030 cells containing a selection plasmid, which contained a single G to A point mutation in the active site portion of the chloramphenicol resistance gene. Cells were cultured overnight and plated on concentrations of chloramphenicol which were higher than the MIC of the S1030 cells with the selection plasmid. Surviving colonies were sub-cloned and re-challenged under the selection conditions and then sequenced to identify the genotype of the productive variants. Sanger sequencing analysis revealed that a D108N, a D108V, and a D108G mutation conferred the desired phenotype (A to G transition mutation in DNA). Subsequent studies involving individual clones isolated from this first round of evolution demonstrated that the D108N mutation was the optimal substitution at this site.

Figure 17:
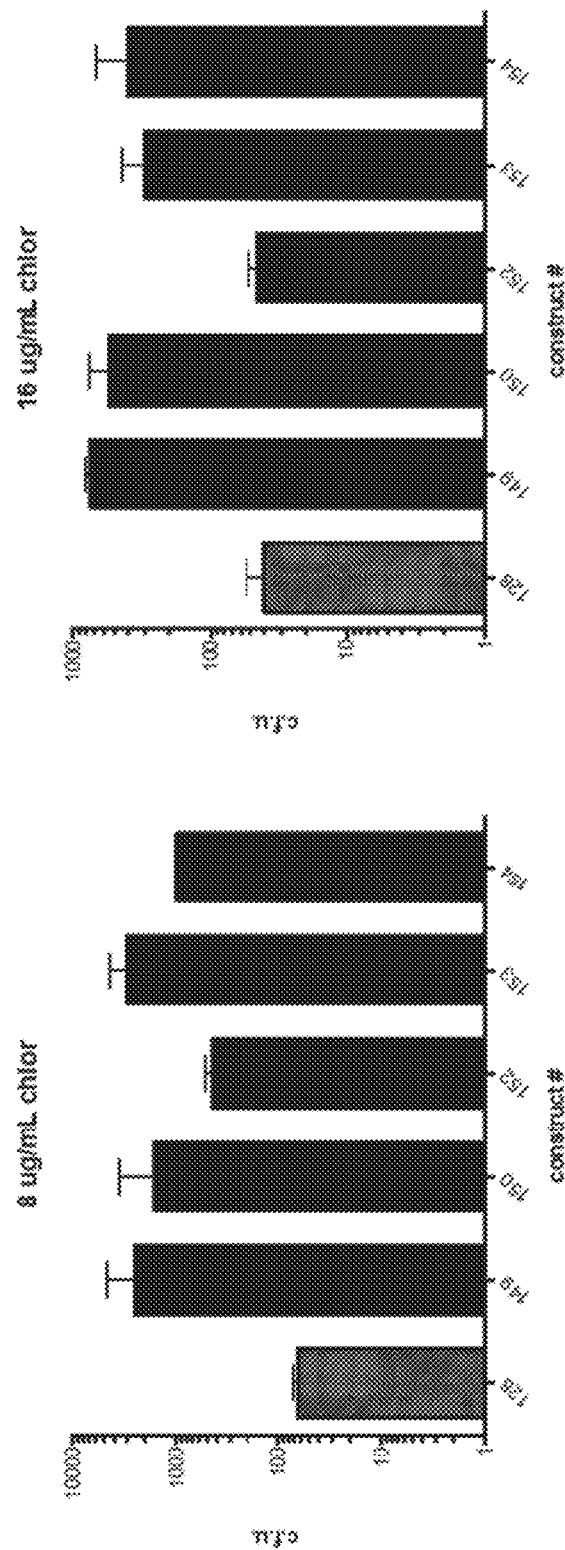
FIG. 17 shows the results of individual clone antibiotic challenge assays. The identity of the construct numbers correspond to the pNMG clone numbers from FIG. 16.
Figure 17:
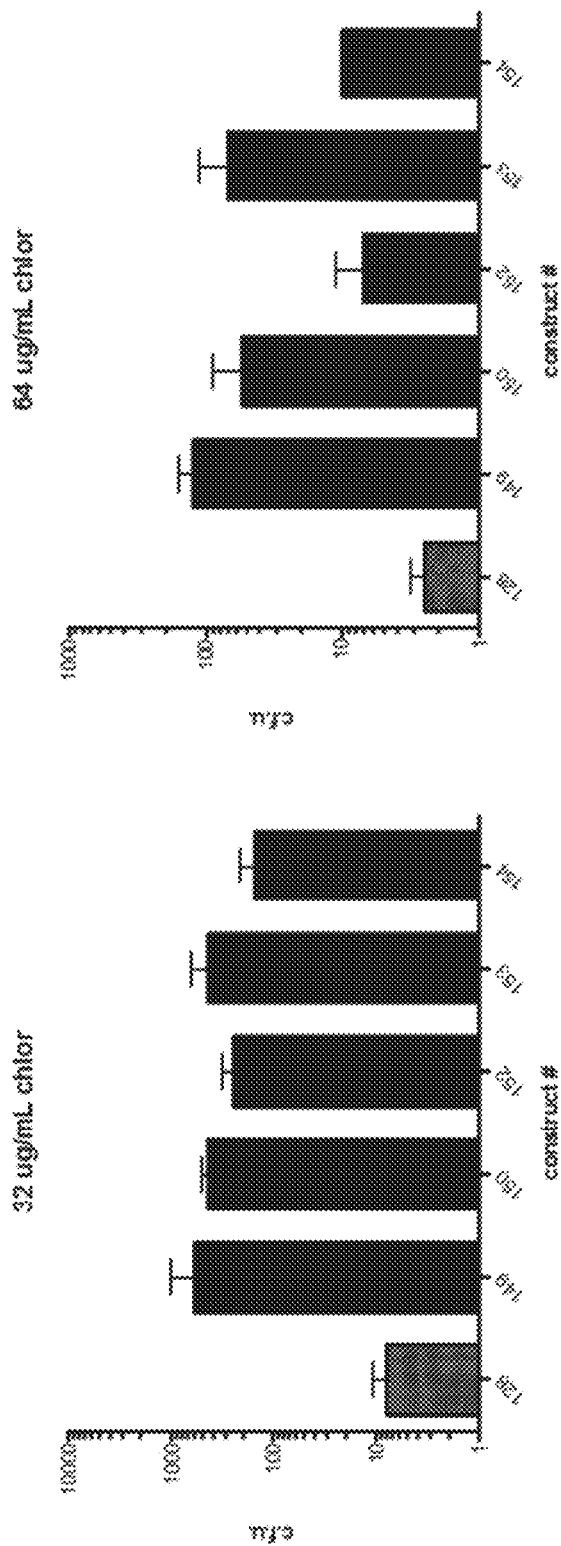
Figure 18:
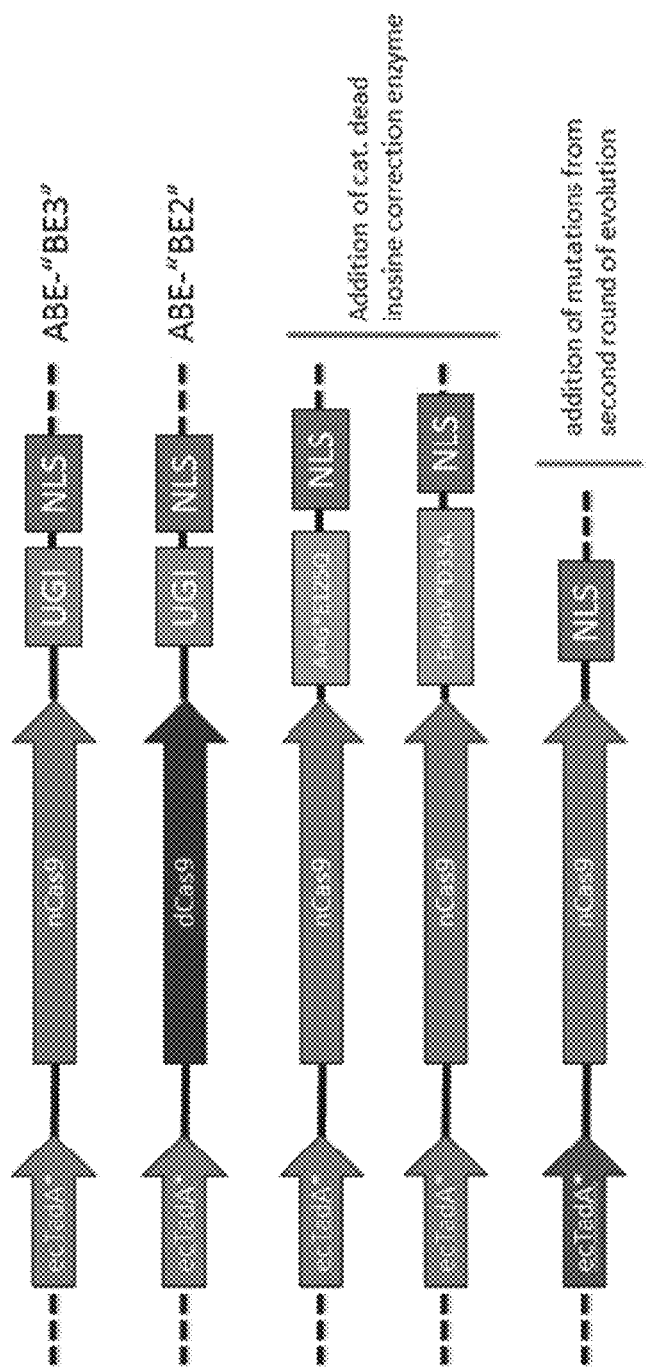
FIG. 18 show schematic representations of new constructs that were developed. New constructs include UGI, AAG*E125Q, and EndoV*D35A domains.

A second round of evolution was performed by evolving ecTadA containing a D108N mutation (see construct 3, clone 5, as listed in FIG. 11 (pNMG-128), which was identified from first round of evolution. pNMG-128 also contains mutations H8Y and N127S, which are "hitch-hiker" mutations. The evolved clones of the resulting library were challenged with 32, 64 and 128 ug/mL chloramphenicol (higher stringency than 1st round evolution of 1, 2 and 4 ug/mL). Clones which survived on 32, 64 and 128 ug/mL chloramphenicol were subcloned and re-plated, individual clones from this enrichment were isolated and assayed. The number of colony forming units (C.F.U) for each construct, pNMG-128 and pNMG 149-154, are shown in FIG. 17 under varying concentrations of chloramphenicol. A second round of evolution with high stringency conditions resulted in a high frequency of mutations at D147 and E155 of ecTadA, which are highlighted in FIG. 16.

Figure 23:
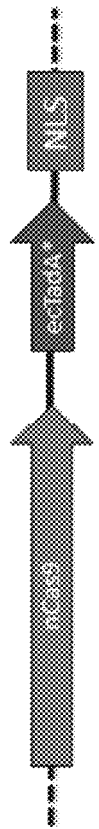
FIG. 23 shows inactive C-terminal Cas9 fusions of ecTadA for constructs pNMG-164 through pNMG-173. The sequence corresponds to SEQ ID NO: 41.
Figure 24:
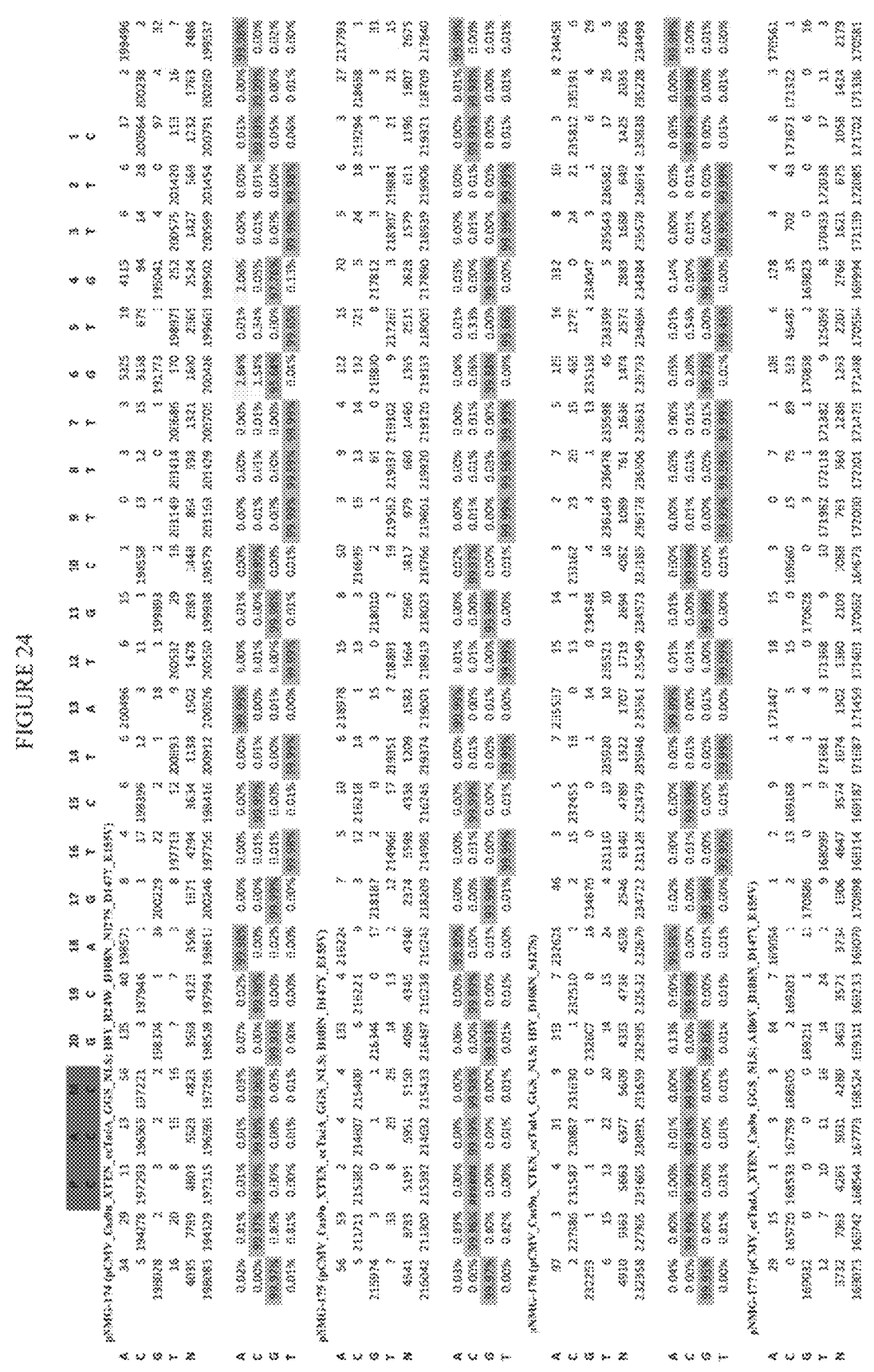
Figure 25:
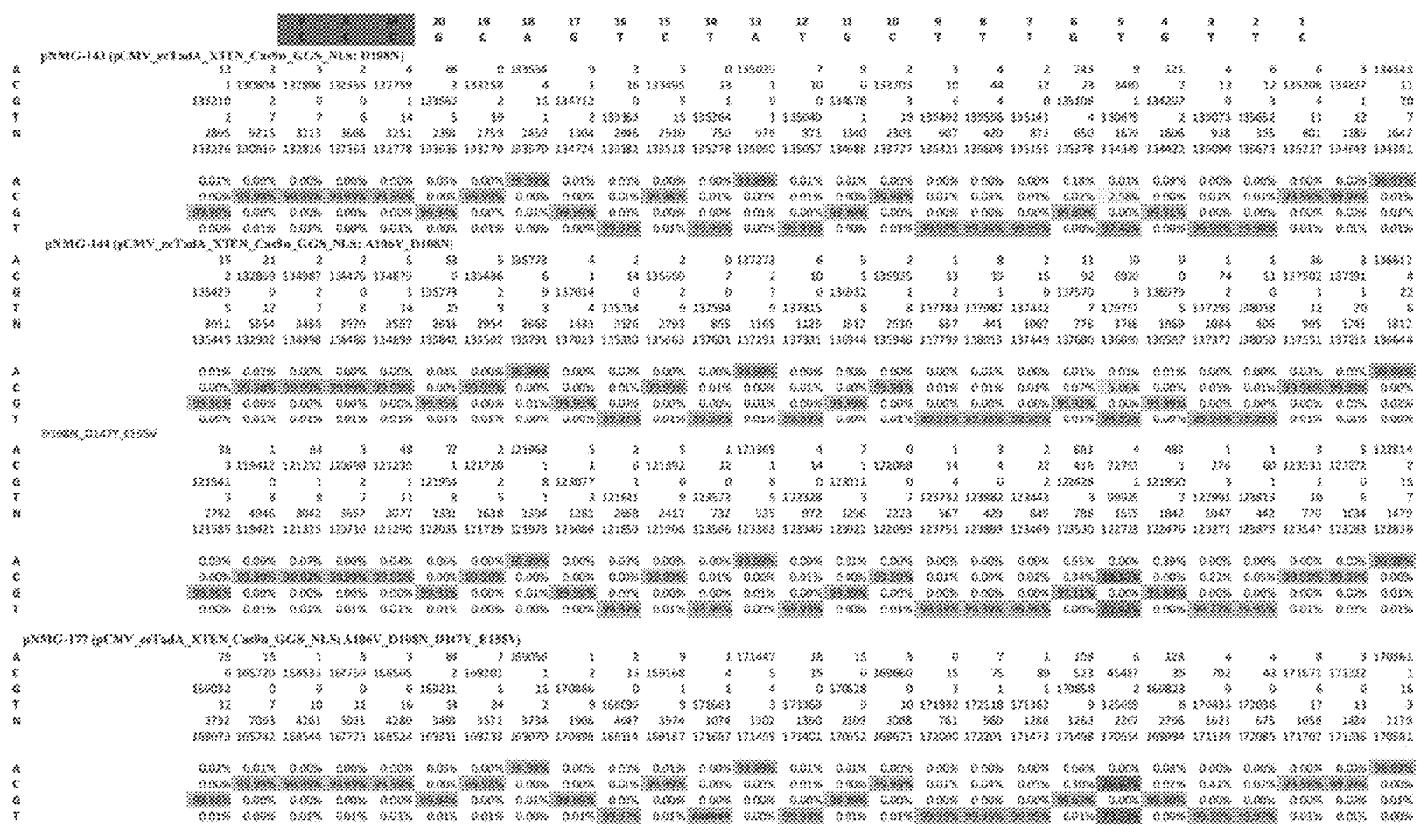
Figure 26:
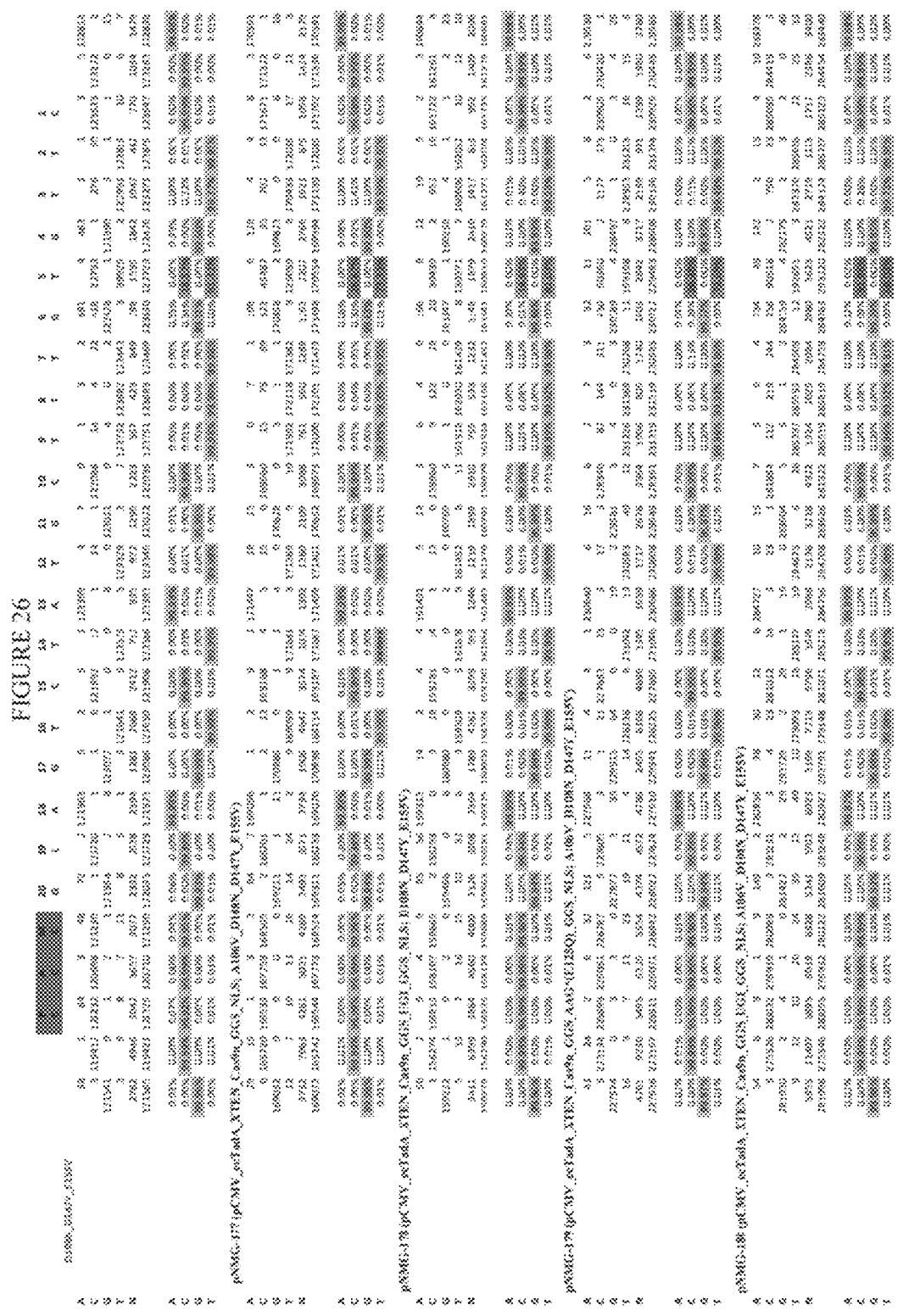
Figure 27:
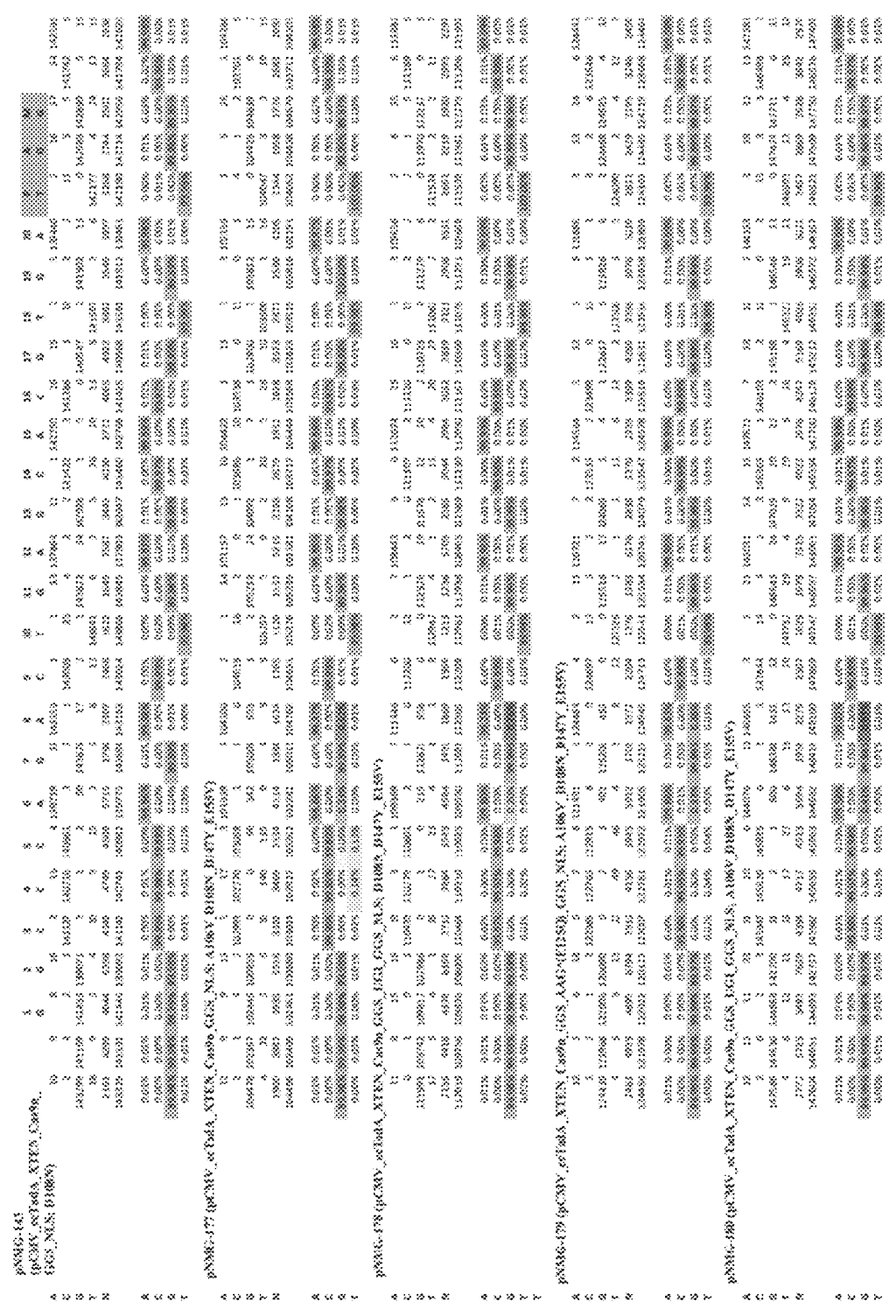

FIGS. 23-27 show the results of transfections of various ABE constusts into Hek293T cells, using a gRNA to direct the editor to the various genetic loci. FIG. 23 shows pNMG-164, 171, 172, and 173 editing on Hek-2. FIG. 24 pshows NMG-174-177 editing on Hek-2. FIG. 25 shows pNMG 143, 144, 164, 177 editing on Hek-2. FIG. 26 shows pNMG-164, pNMG-177, pNMG-178, pNMG-179, and pNMG-180 editing on Hek-2. FIG. 27 shows pNMG-164, 177-180 editing on Hek-2.

Regarding FIGS. 28-45, mammalian codon optimized constructs of ecTadA containing mutations at D108, (in some cases the mutations included the following: D108N, D108G, D108V) were used to probe whether D108 mutations identified in the first round of evolution also catalyzed A to G reversion in mammalian cells. Constructs pNMG-142-147 were transfected into Hek293T cells, and showed the greatest amount of A to G editing efficiencies at position #5 of the Hek-2 site, with low to no editing of adenines at any other sites. Exemplary DNA sequences that were targeted are described below as HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46). Subsequent experiments and evolutions have increased the editing efficiencies and identified that the editing window generally occurs at positions 4-6 in the protospacer and with a surrounding sequence of "YAC"; where "Y" is a pyrimidine (T or C) base and the underlined nucleotides, in the sequences below, is the PAM sequence. For the Hek2 sequence (SEQ ID NO: 41), shown below, the protospacer positions are indicated as 1-20 going from right to left. Position 5 of the protospacer at the Hek2 site is a T, which is opposite the A that may be edited by any of the adenosine deaminases described herein. For the Hek3, Hek4 RNF2, FANCF and EMX1 sequences (SEQ ID NOs: 42-46), shown below, the protospacer positions are indicated as 1-20 going from left to right. For these sequences one or more of the adenines (As), such as the A at position 6 of the Hek3 site (SEQ ID NO: 41), may be edited by any of the adenosine deaminases described herein. It should be noted that transfection of pNMG-142 (wild-type ecTadA fused to nCas9) produced no observable amounts of editing, underscoring the importance and necessity of implementation of the mutations arising from the directed evolution experiments. Target sequences used in the Examples are provided below (PAM sequences are underlined in bold):

```
Hek2:
                                   (SEQ ID NO: 41)
CCCGCAGTCTATGCTTTGTGTTC

Hek3:
                                   (SEQ ID NO: 42)
GGCCCAGACTGAGCACGTGATGG

Hek4:
                                   (SEQ ID NO: 43)
GGCACTGCGGCTGGAGGTGGGGG

RNF2:
                                   (SEQ ID NO: 44)
GTCATCTTAGTCAGGACCTGAGG

FANCF:
                                   (SEQ ID NO: 45)
GGAATCCCTTCTGCAGCACCTGG

EMX1:
                                   (SEQ ID NO: 46)
GAGTCCGAGCAGAAGAAGAAGGG
```

Engineering Adenosine Base Editors with Domains that Inhibit Reversion of Inosine to Adenine It was hypothesized that blocking inosine reversion to adenine, for example as a result of endogenous hAAG activity, could improve base editing efficiency. Accordingly, experiments were performed to examnine the effect of adding a catalytically inactive alkyl adenosine glycosylase to the C-terminal end of ABE editors. Base editor 3 (BE3) in these transfections served as the positive control for C to G base editing, pNMG-142 is the negative control, pNMG-143 is an evolution round #1 construct, pNMG-144 (D108N) is another evolution round #1 construct (A106V_D108N). The mutations in the pNMG-156 construct are all mutations identified from the highest frequency amplicons resulting from the first round of ecTadA bacterial evolution (including "hitch-hicker" mutations). Hitch-hiker mutations refer to mutations that were identified in evolution experiments, but may not have a significant effect on adenosine base editing. A method for identifying hitch-hiker mutations is to do reversion anaylsis and then re-assay the construct to determine whether the mutation has an effect on base editing. pNMG-156 is the mammalian codon-optimized version of pNMG-128 (the bacterial vector I isolated in the selection) with contains a C-terminal UGI. pNMG-160 is the equivalent of pNMG-143 having a catalytically inactive AAG (E125Q), pNMG-161 is pNMG-143 having a catalytically inactive Endo V (D35A). Mutations E125Q and D35A correspond to the mutations in the catalytically dead AAG and EndoV open reading frame (ORF), respectively. pNMG-162 thas the same construct architecture as pNMG-156, except it does not contain UGI. The ability of these constructs to deaminate adenosine in the target sequences, HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46) is shown in FIGS. 28-33, respectively. In general, it was found that, for the constructs tested, incorporation of UGI, AAG(E125Q), or EndoV (D35A)C-terminal to the ecTadA and the Cas9 domain did not provide a significant increase in the efficiency of the base editors to generate an adenosine to guanine mutation.

Arranging the Adenosine Deaminase Domain Relative to the Cas9 Domain

Arrangement of the adenosine deaminase domain (e.g., ecTadA) relative to the Cas9 domain in adenosine base editors was tested. For example, it was tested whether placement of the adenosine deaminase N-terminal or C-terminal relative to a Cas9 domain affected base editing efficiency. Further, experiments including mutations from evolution #1 of ecTadA and evolution #2 of ecTadA were compared. See FIGS. 34-39. In general, the mutations identified in evolution #2 improved the editing efficiencies of the ABE editors identified in evolution #1. Additionally, it was found that adenosine base editors were active (mutated adenine to guanine) when the adenosine deaminase was arranged N-terminal to Cas9. Adenosine base editor constructs where the adenosine deaminase was arranged C-terminal to Cas9 showed little to no observable editing of adenine to guanine.

The following ABE constructs were transfected into Hek293T cells; pNMG-142, which served as a negative control (no mutations in ecTadA); pNMG-143 (where ecTadA has a D108N mutation), pNMG-144 (where ecTadA has a A106V, and a D108N mutation) and pNMG-164 (where ecTadA has a D108N, a D147Y, and a E155V mutation). These constructs were mammalian codon optimized constructs with mutations from evolution #1. Construct pNMG-171 served as a control for the C-terminal TadA fusion constructs of pNMG-172 to pNMG-176, which contain various ecTadA mutations. pNMG-171 contains a C-terminal wild-type ecTadA fusion to nCas9, whereas pNMG-172-176 contain mutations in TadA identified from evolution #1. pNMG-177 and pNMG-178 represent two mammalian codon optimized plasmids with mutations identified from evolution #2, where pNMG-178 contains a UGI domain. pNMG-179 and pNMG-180 are the same as pNMG-177 but with an added C-terminal catalytically inactive AAG (E125Q), and a UGI domain, respectively. The ability of these constructs to deaminate adenosine in the target sequences, HEk2 (SEQ ID NO: 41), Hek3 (SEQ ID NO: 42), Hek4 (SEQ ID NO: 43), RNF2 (SEQ ID NO: 44), FANCF (SEQ ID NO: 45), and EMX1 (SEQ ID NO: 46) is shown in FIGS. 34-39, respectively.

In general, it was found that fusing the adenosine deaminase (ecTadA)N-terminal to the Cas9, as opposed to C-terminal, yielded more efficient base editing of adenine. It was also found that ecTadA containing the mutations A106V, D108N, D147Y, and E155V performed better (e.g., edited adenine more efficiently) than the other ecTadA mutations tested in evolution #1 and evolution #2. Further, it was found that for the constructs tested, incorporation of UGI, or AAG(E125Q), in these constructs did not provide a significant increase in the efficiency of the base editors to generate an adenosine to guanine mutation.

Figure 40:
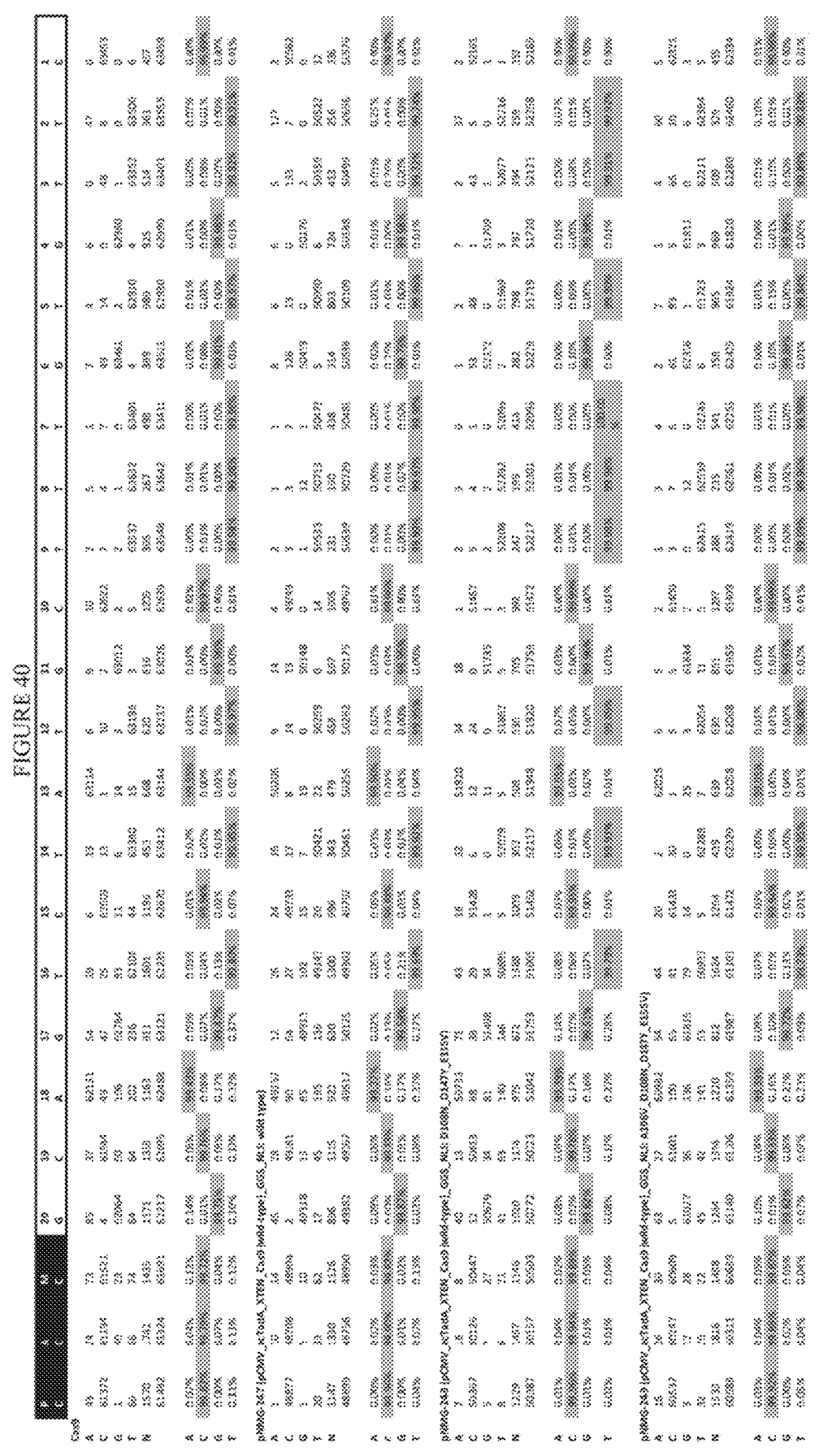
Figure 40:
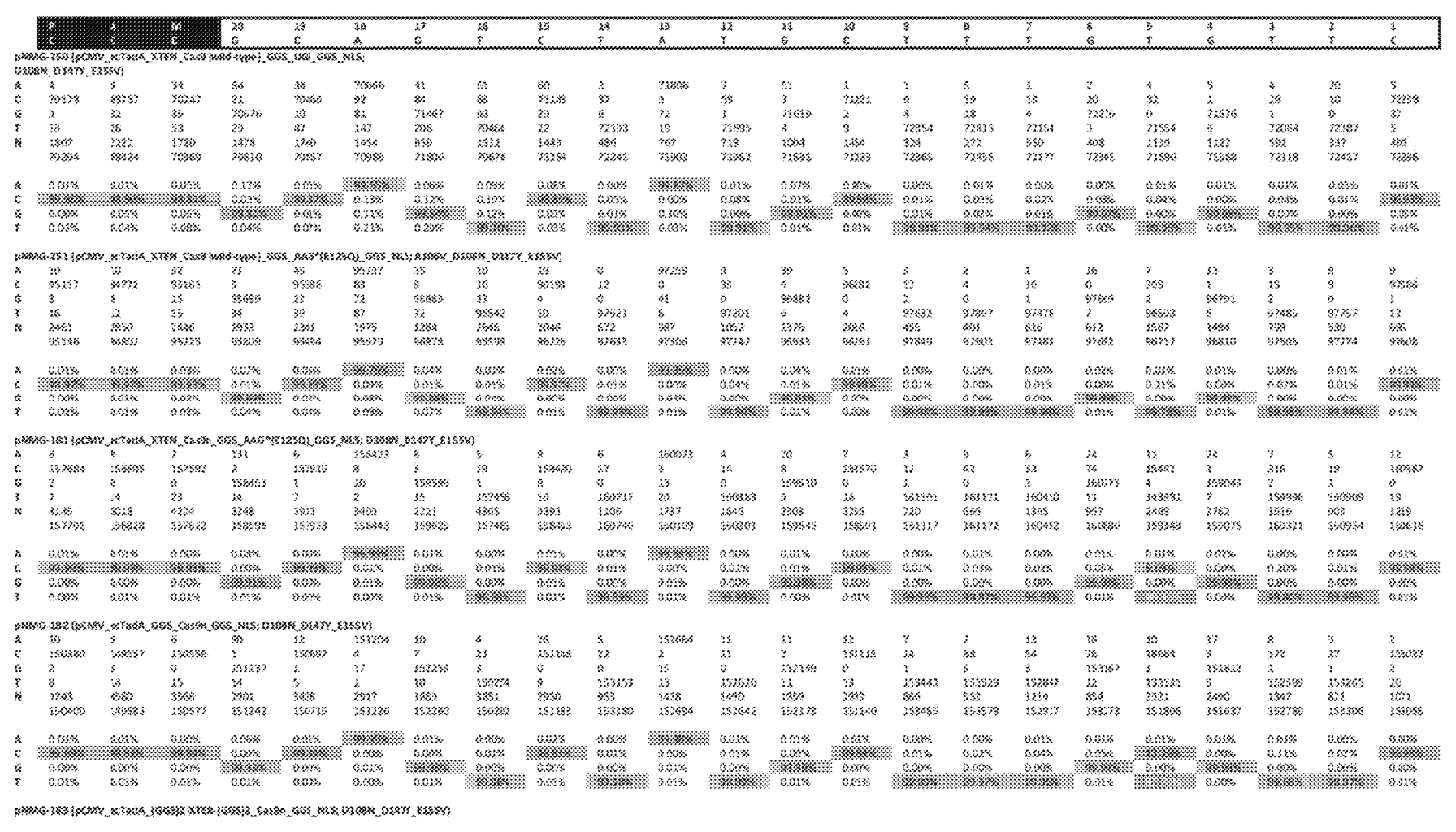
Figure 40:
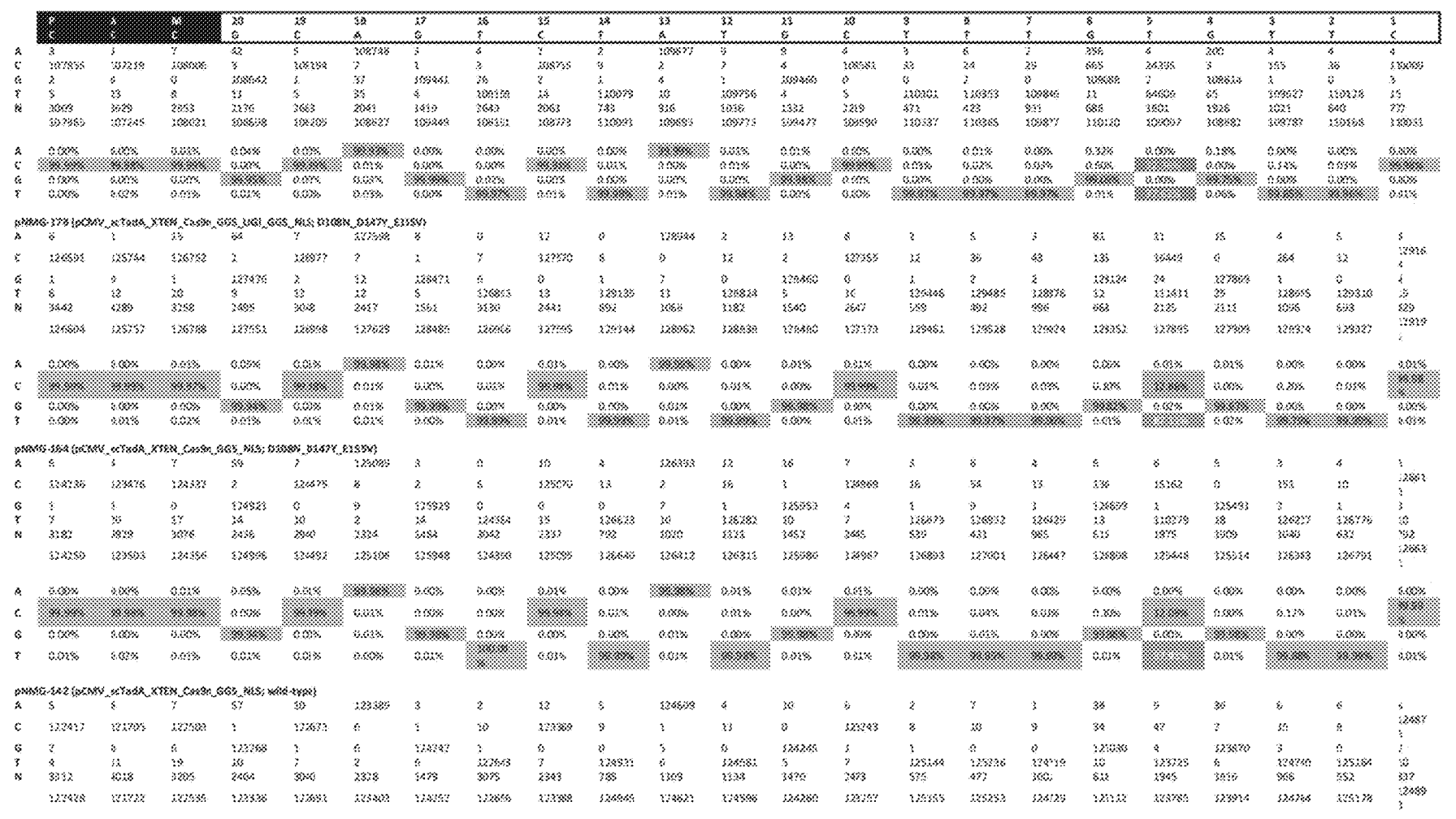
Figure 40:
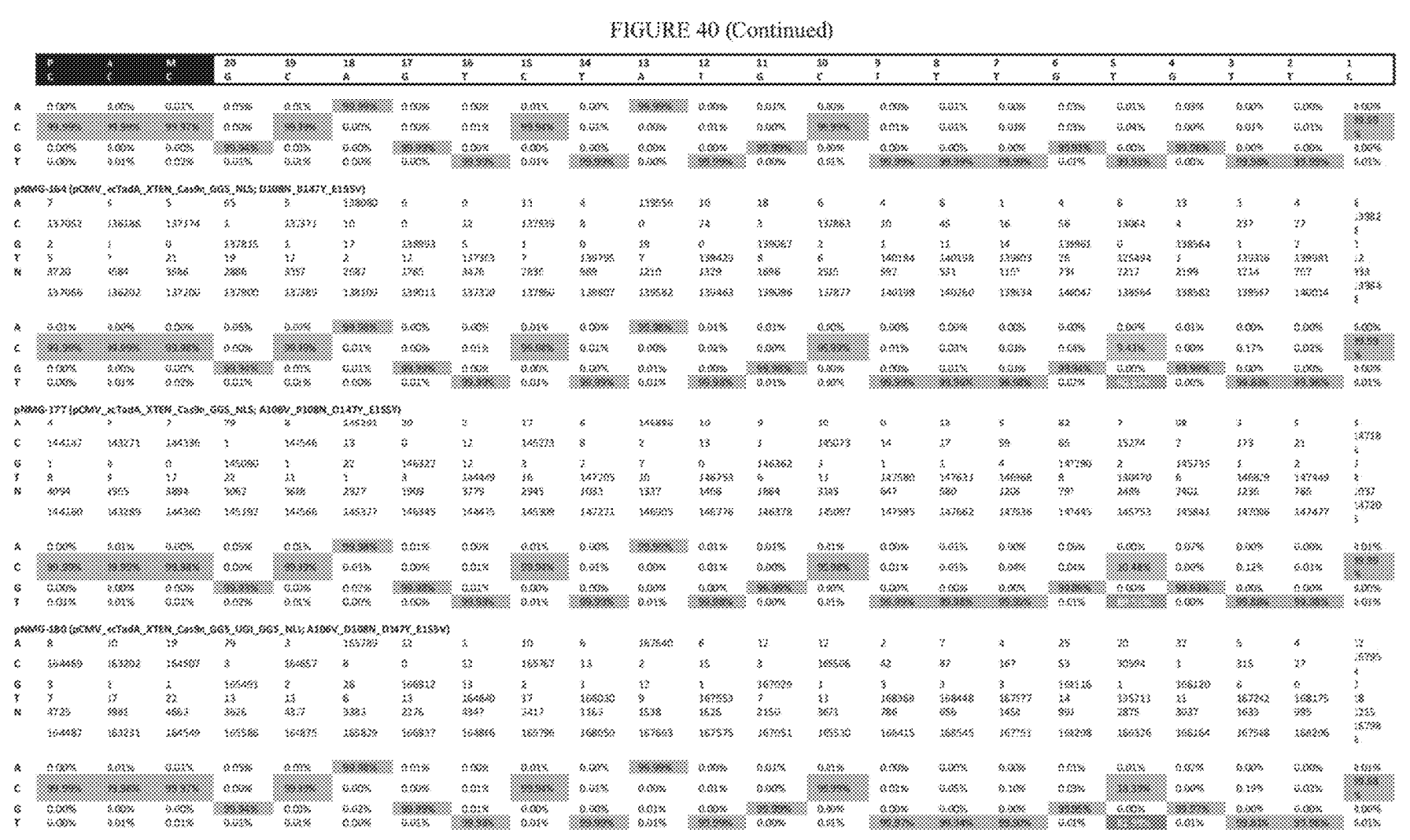
Figure 40:
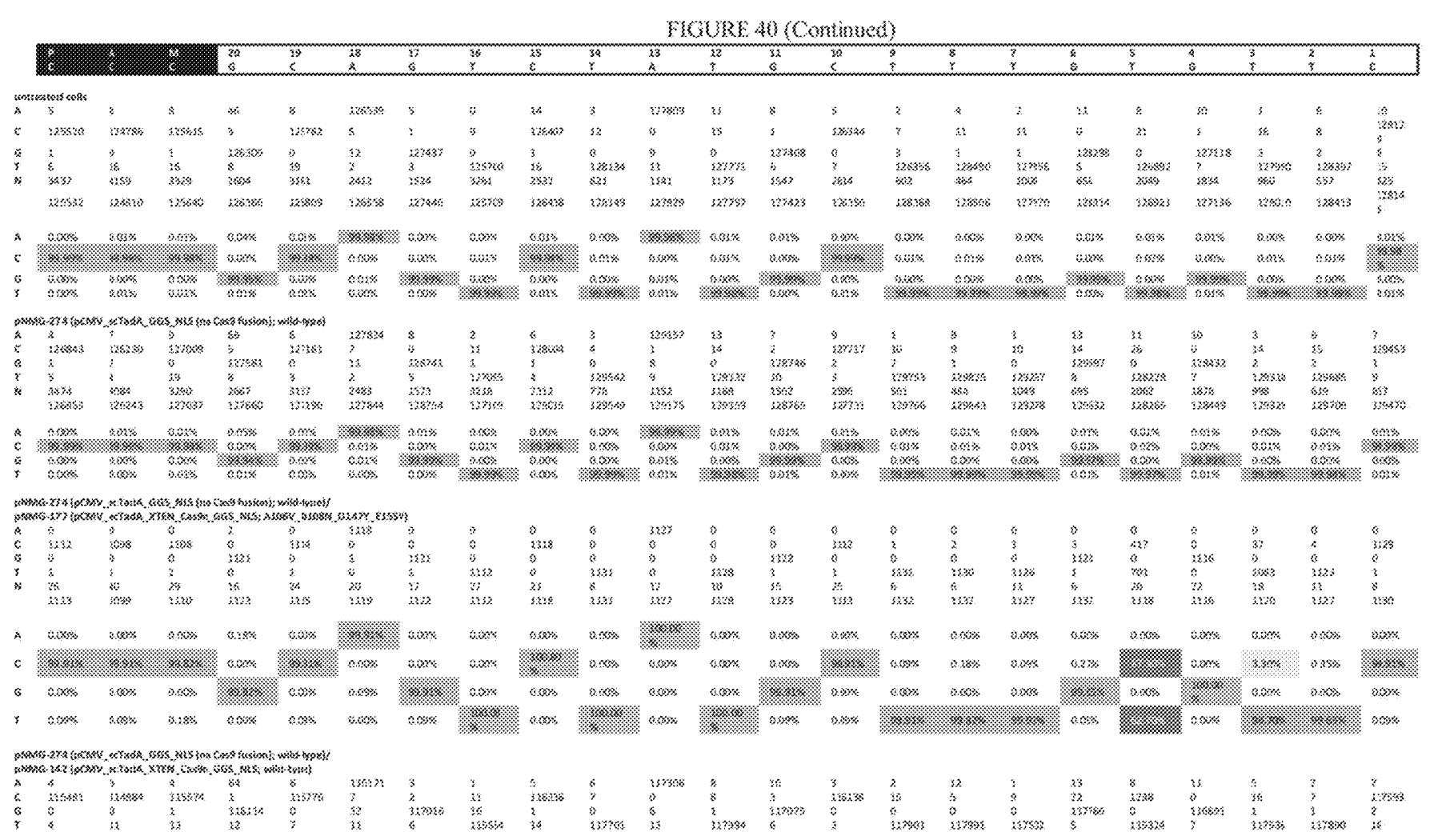
Figure 40:
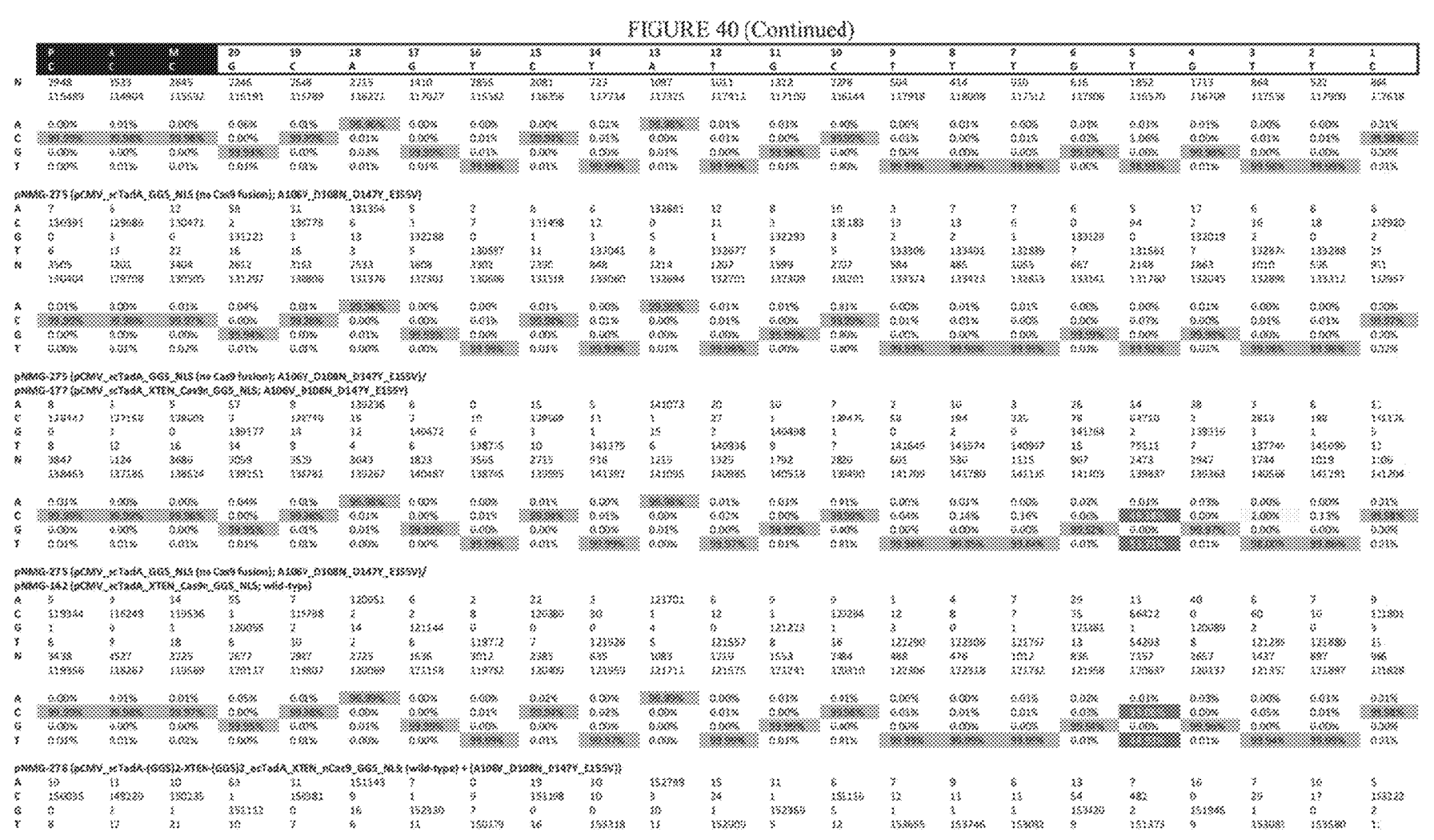
Figure 40:
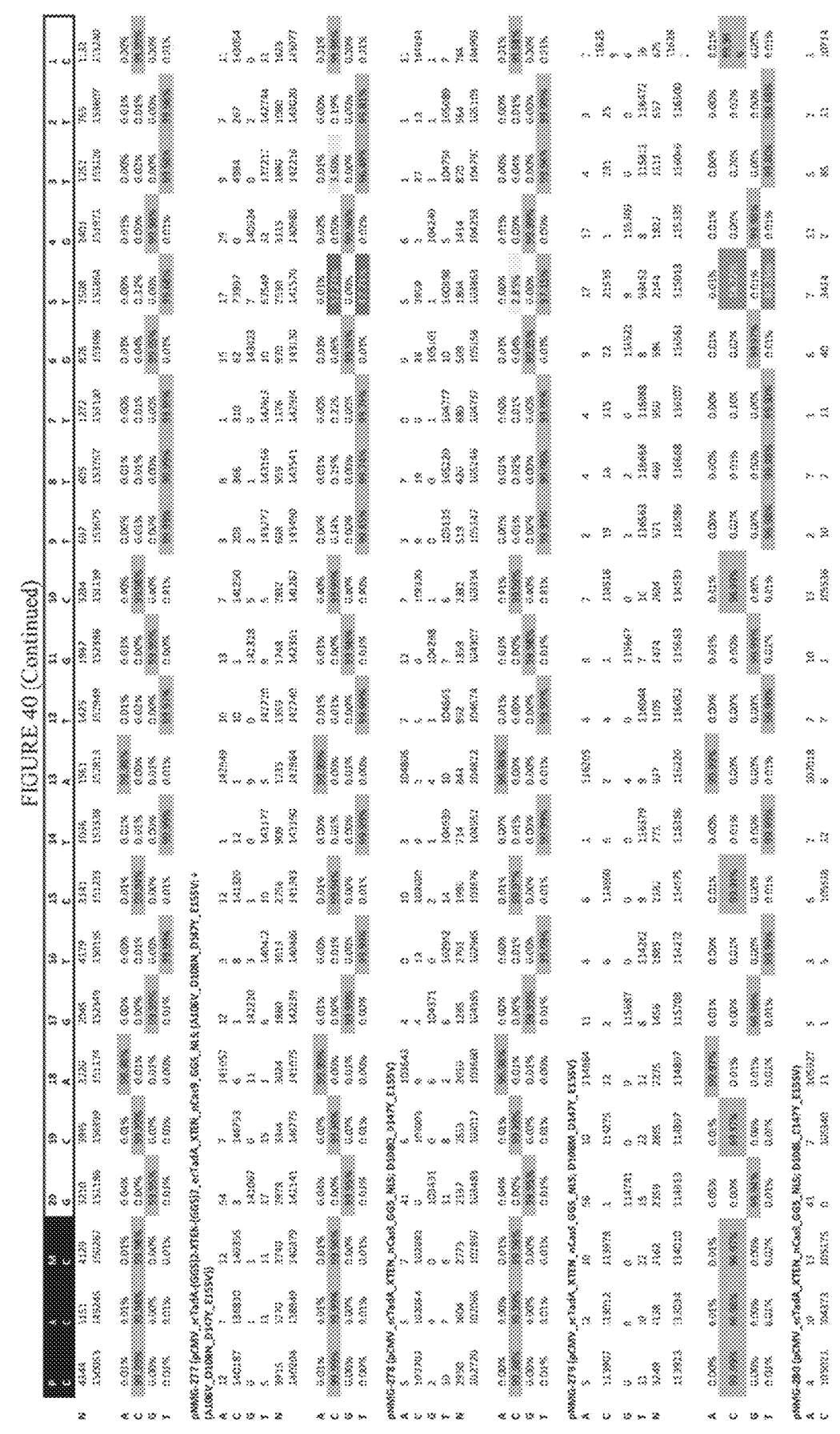
Figure 40:
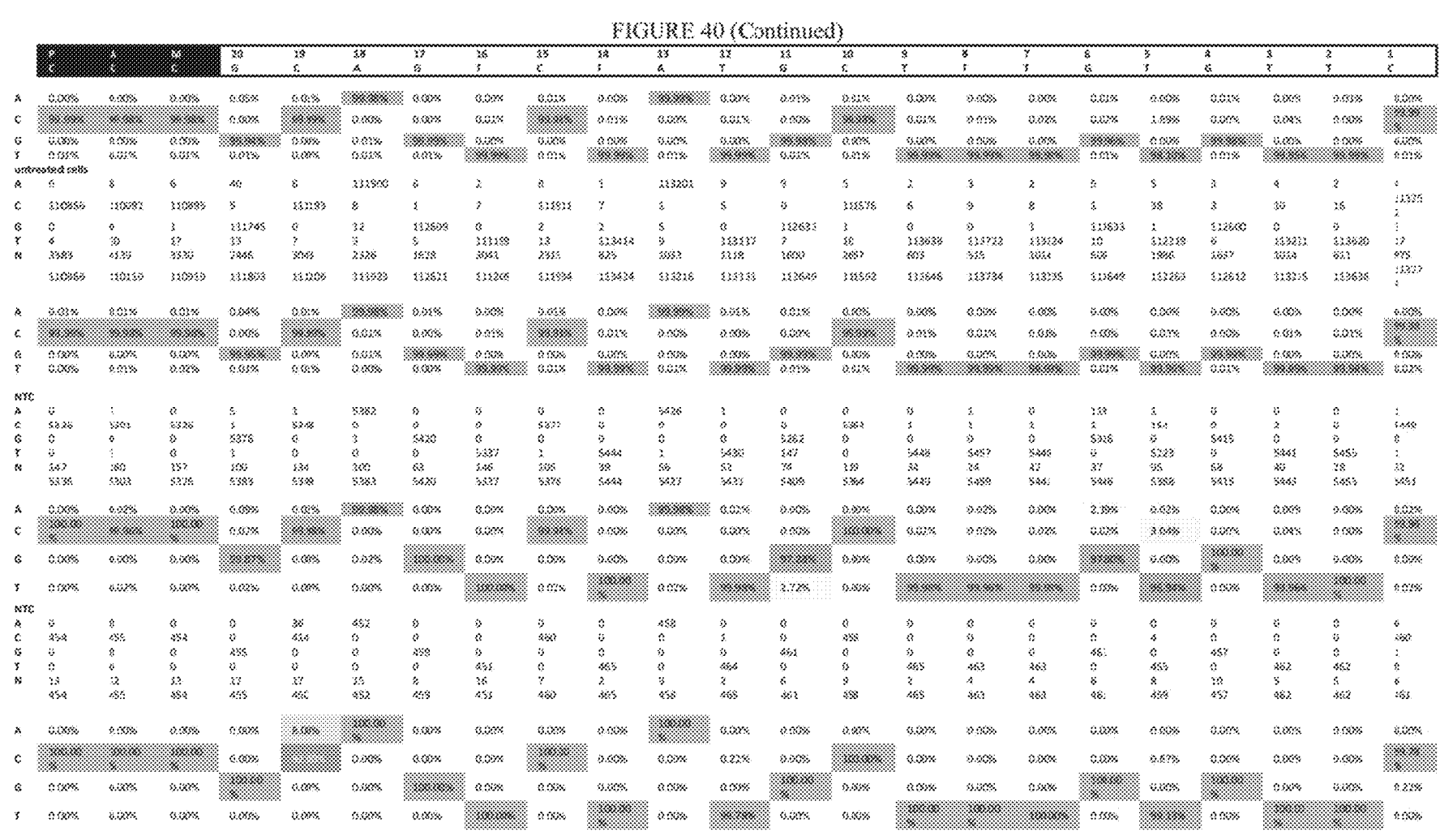

The transfection experiments shown in FIG. 40 were performed to determine four key points: One, whether ecTadA interferes with gRNA/Cas9 binding by deaminating As in the RNA of the guide. Two, whether a short linker (GGS only) or a long linker ((SGGS)$_2$-XTEN-(SGGS)$_2$) ((SGGS)$_2$) corresponds to SEQ ID NO: 2) between the evolved deaminase and Cas9 affects window size and/or overall editing efficiencies of ABE. Three, whether or not dimerization of evolved ecTadA improves ABE editing efficiencies. Four, if other substitutions at the position D108 in TadA could further enhance editing efficiencies. It was found that the ABE editors do not interfere with gRNA/Cas9 binding and that dimerization of ecTadA does improve editing efficiencies. To test whether ABE interferes with gRNA/Cas9 binding nCas9 was replaced with wild-type Cas9 in various evolved ABE constructs (pNMG-247-251) and compared INDEL rates to Cas9 (wt) only INDEL rates (see FIG. 48). A to G editing efficiencies are undetectable in FIG. 40 for pNMG-247-251, likely due to wild-type Cas9 nuclease activity. It was also determined that the long linker between the evolved ecTadA and nCas9 (pNMG-183) yielded higher editing efficiencies relative to XTEN only and GGS only linkers. Most strikingly, dimerization of the ecTadA unit of ABE was tested both in trans by co-transfecting equimolar amounts of ecTadA (with and without mutations from evolution) with ABE editors pNMG-142 (neg control), pNMG-177 (A106V_D108N_D147Y_E155V) and in cis by making editors in which two untis of ecTadA were covalently tethered (with a (SGGS)$_2$—XTEN-(SGGS)$_2$ linker). Monomeric units used for in trans dimerization expeiments are pNMG-274 and pNMG-275. Covalent fusions of two untis of ecTadA in the ABE editor are represented in pNMG-276 (negative control, two units of wild-type TadA in the ABE editor) and pNMG-277. Lastly, transfections with plasmids pNMG-278-283, which represent ABE editors that have varying mutations at D108 position in ecTadA (e.g. D108M, D108Q, D108K, etc), showed that the D108N substitution originally identified in round #1 evolution is the best performing mutation at this position.

Example 3—Development of Adenosine Base Editors (Evolution #3)

An ecTadA construct with the consensus mutations A106V, D108N, D147Y (pNMG-184) and E155V was mutagenized with error-pone PCR and the resulting ABE library was targeted with 2 separate gRNAs to two different sites in a kanamycin resitance gene which require two A to G reversions (both in premature stop codons) to conder kanamycin resistance. The 2 gRNA/2 target approach was used to increase the stringency of the selection. This evolution resulted in the identification of the following new mutations: L84F, H123Y and I157F.

Deaminase editing sgRNA

During the development of ABE, it was questioned whether or not the deaminase was editing the sgRNA and did TadA still have RNA activity. Based on the results shown in FIG. 48, fusions appeared to bind well, but there was no significant difference between ABE and Cas9 indel percentage. This demonstrates that ABE is not interfering or modifying the gRNA strand. Differences between wt Cas9 only and ABE fused to wild-type Cas9 would suggest deaminase interference with the gRNA. This was not the case.

Figures 50, 51, 52:
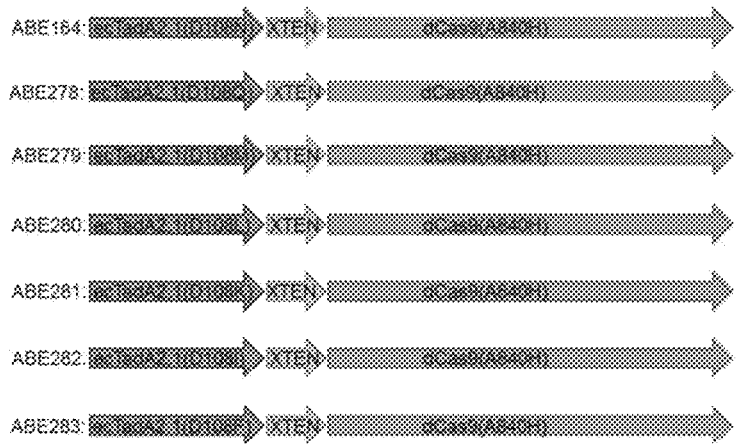
FIG. 50 shows constructs developed for fusions at various sites using further mutated D108 residue.
FIG. 51 shows the protospacer and PAM sequences of base editing sites set forth in SEQ ID NOs: 6, 46, and 42 from top to bottom, respectively.
FIG. 52 shows the results of using mutated D108 residues to cause deaminase to reject RNA as a substrate and change the editing outcome.
Figures 53, 54, 55:
FIG. 53 shows the results of using mutated D108 residues to cause deaminase to reject RNA as a substrate and change the editing outcome.
FIG. 54 shows constructs developed for fusions at various sites.
FIG. 55 shows the protospacer and PAM sequences of base editing sites set forth in SEQ ID NOs: 6, 358, 359 from top to bottom, respectively.

It was also questioned whether or not D108 residue could be further mutated to cause deaminase to reject RNA as a substrate. The sgRNAs encoding sites can be found in FIG. 51. Results have shown that a D108M mutation in ecTadA does not significantly improve editing efficiency of the adenosine base editors.

It was found that tethering an additional unit of the mutant TadA to the ABE results in higher editing efficiencies for deamination of the DNA. Tethering an AAG, a base excision repair enzyme, to ABE did not significantly enhance base editing. Tethering catalytically inactivated EndoV, the E. Coli DNA repair enzyme, to ABE also did not significantly enhance base editing. Furthermore, knock-out cell lines of AAG (which revert inosine back to A) had no better editing efficiencies than the parent strain.

Figures 56, 57, 58:
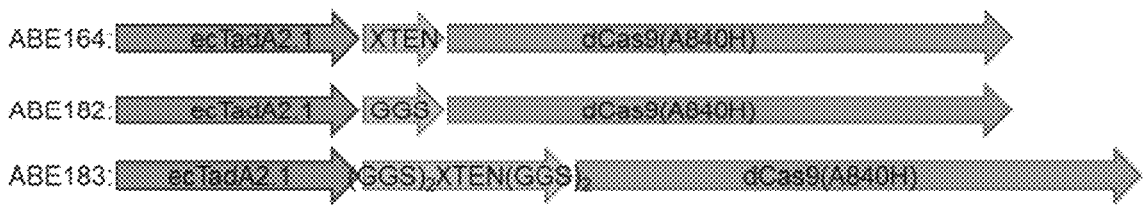
FIG. 56 shows the results of ABE on HEK site 2.
FIG. 57 shows the results of ABE on HEK site 2.
FIG. 58 shows constructs developed for fusions at various sites using various linker lengths.
Figure 61:
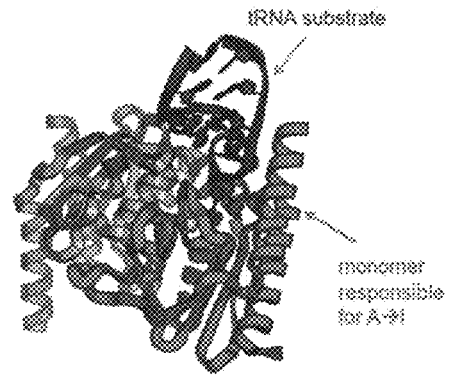
FIG. 61 is a schematic showing the dimerization of deaminase.
Figure 62:
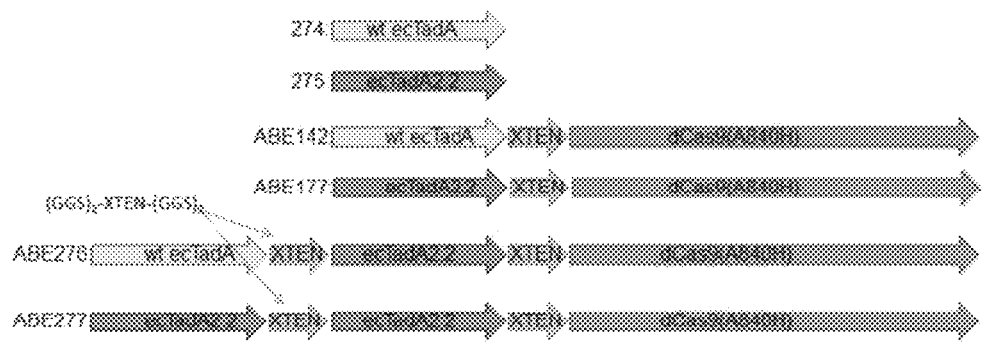
FIG. 62 shows constructs developed for fusions at various sites using various linker lengths.

A next goal was to determine why ABE edit more efficiently on the HEK site 2 than on other sites tested. While adenosine base editors worked well at all sites, they worked optimally at the Hek-2 site. It was theorized that ABE worked best on HEK site 2 due to an abundance of adenine residues. Results shown in FIG. 57 show that this is not the case. Another theory was that linker length could be why ABE only worked on the HEK site 2. Results shown in FIG. 59 and FIG. 60 proved inconclusive. The longest linker to Cas9 between ecTadA and Cas9 enhanced editing efficiencies but did not seem to expand the base editing window. It was also tested whether an ABE efficiently edited Hek-2 similar sites and it was found that there was very efficient editing at Hek-2 similar sites. From this data it was found that the ABEs edited adenines more efficiently when they were part of a "YAC" consensus sequence, where Y is C or T. Also, the tRNA substrate of ecTadA is in the context of "U-A-C" which is YAC.

Figure 63:
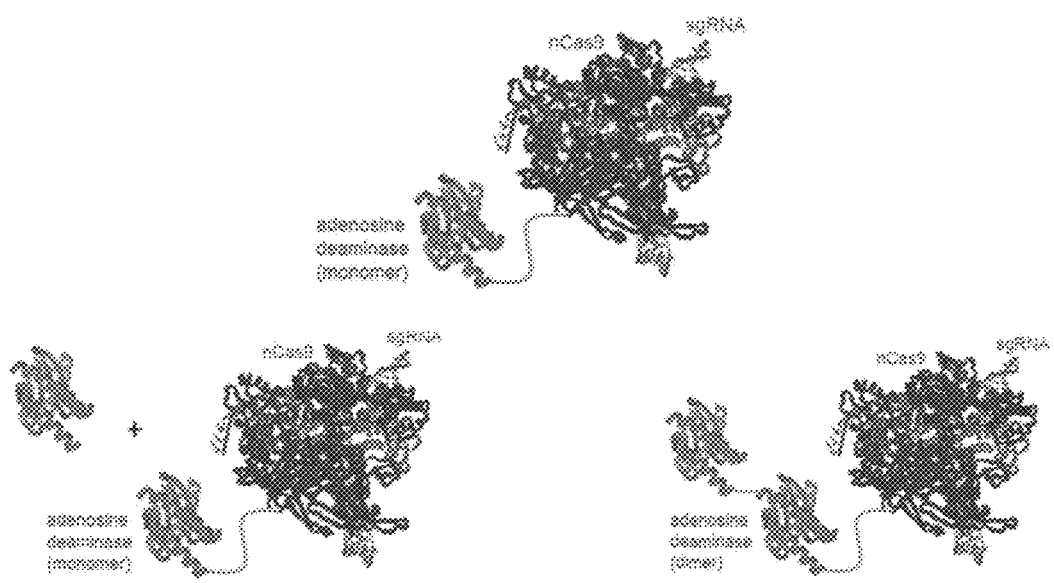
FIG. 63 shows the current editor architecture (top panel), the in trans dimerization (bottom panel, left), and the in cis dimerization (bottom panel, right).
Figures 64, 65:
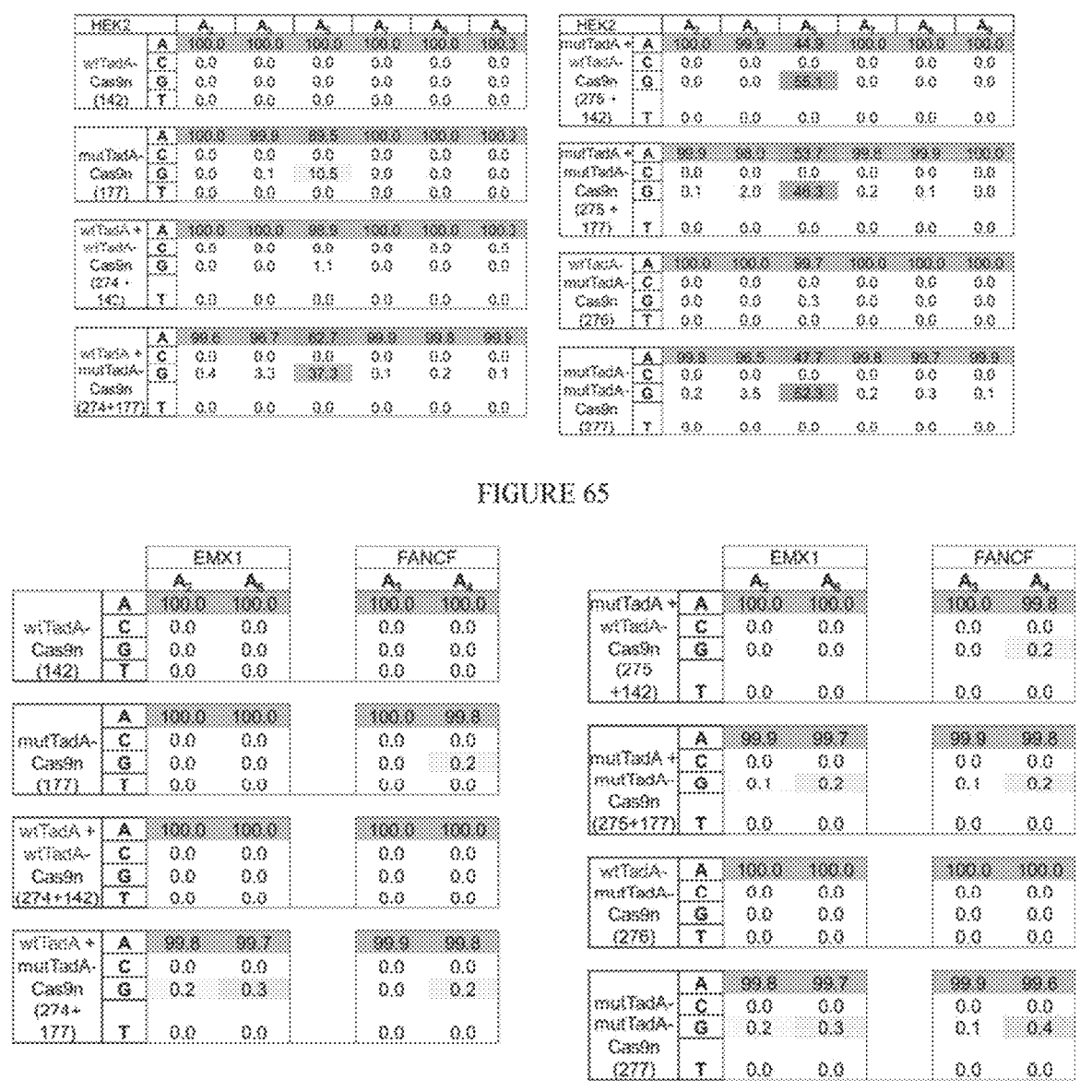
Figures 66, 67:
FIG. 66 shows dimerization results from base editing.
FIG. 67 shows constructs developed for fusions at various sgRNA sites.
Figure 68:
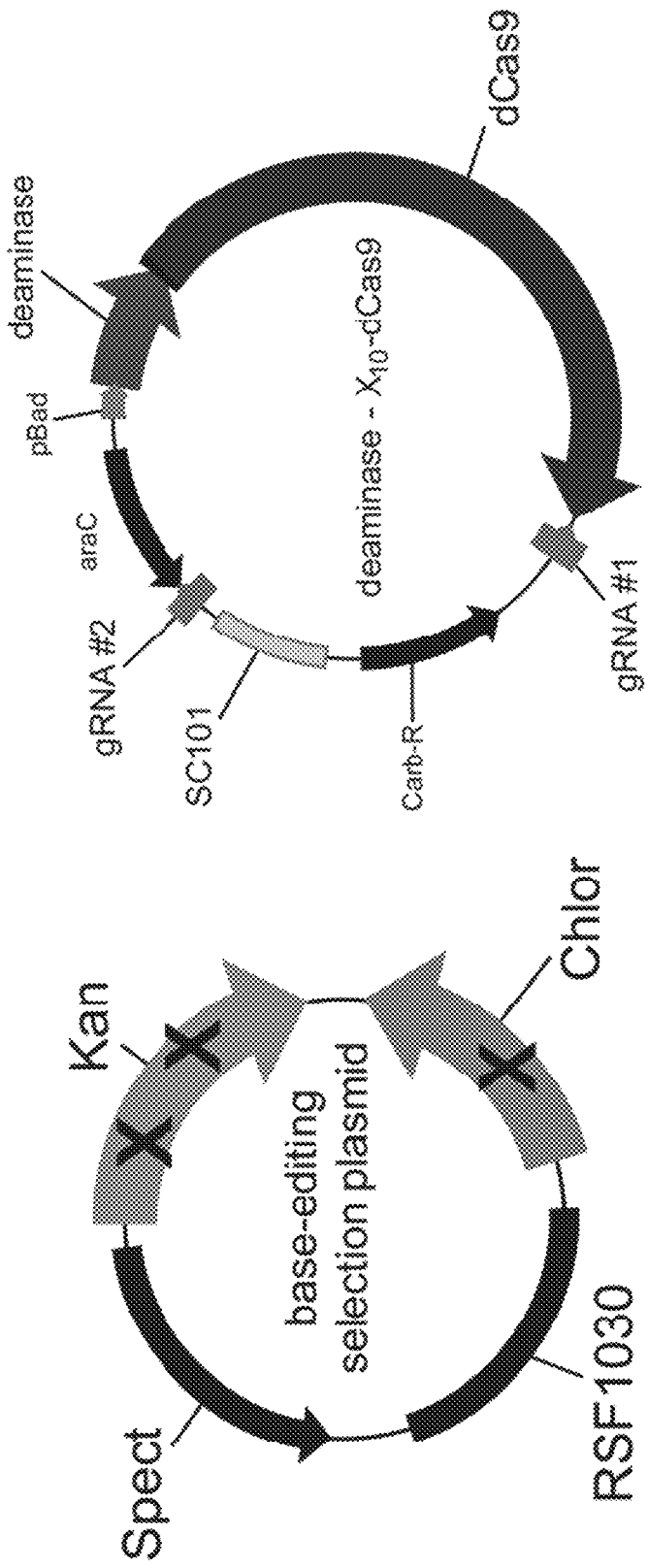
FIG. 68 shows the evolution of ABE editor against new selection sequences. The sequences from top to bottom and left to right correspond to SEQ ID NOs: 707-719, respectively.
Figure 69:
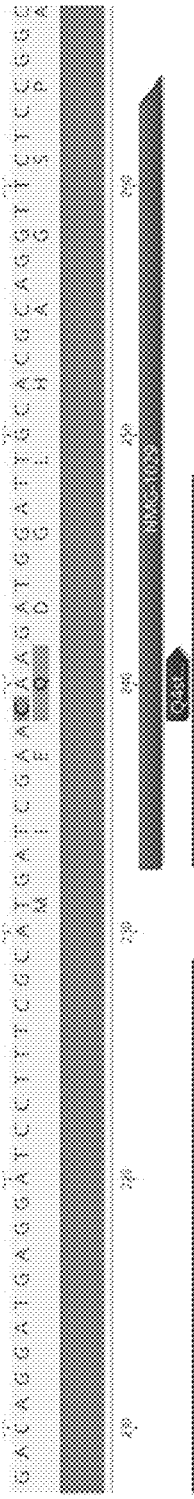
FIG. 69 shows the current editor targeting Q4 stop site. The sequences from top to bottom and left to right correspond to SEQ ID NOs: 624-627, 5527, and 628.
Figure 70:
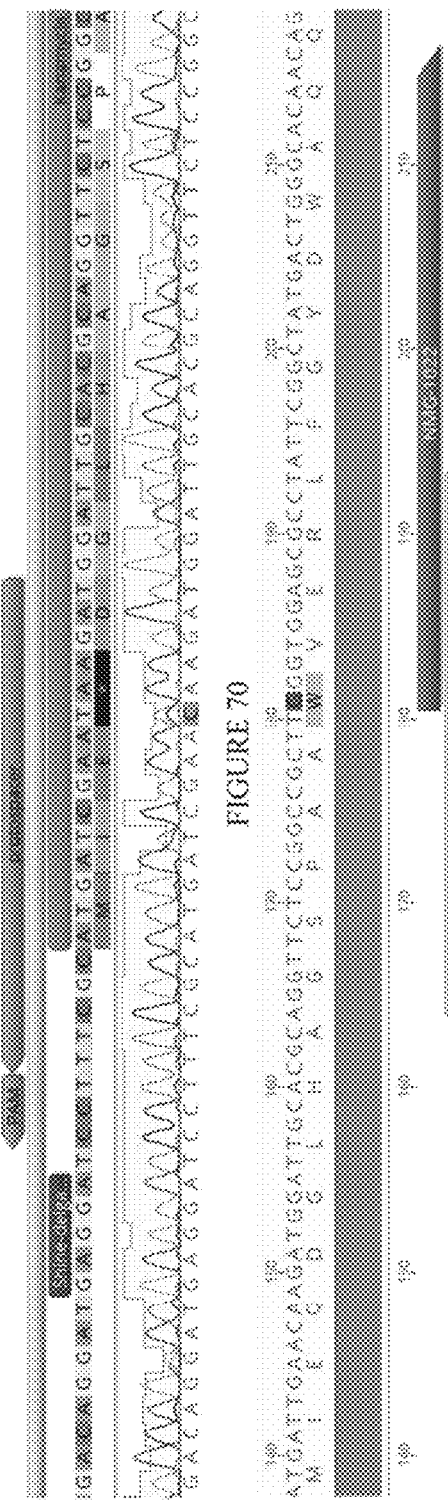
FIG. 70 shows the current editor targeting W15 stop site. The sequences correspond to SEQ ID NOs: 629-632, 5528, and 633 from top to bottom and left to right, respectively.
Figure 79:
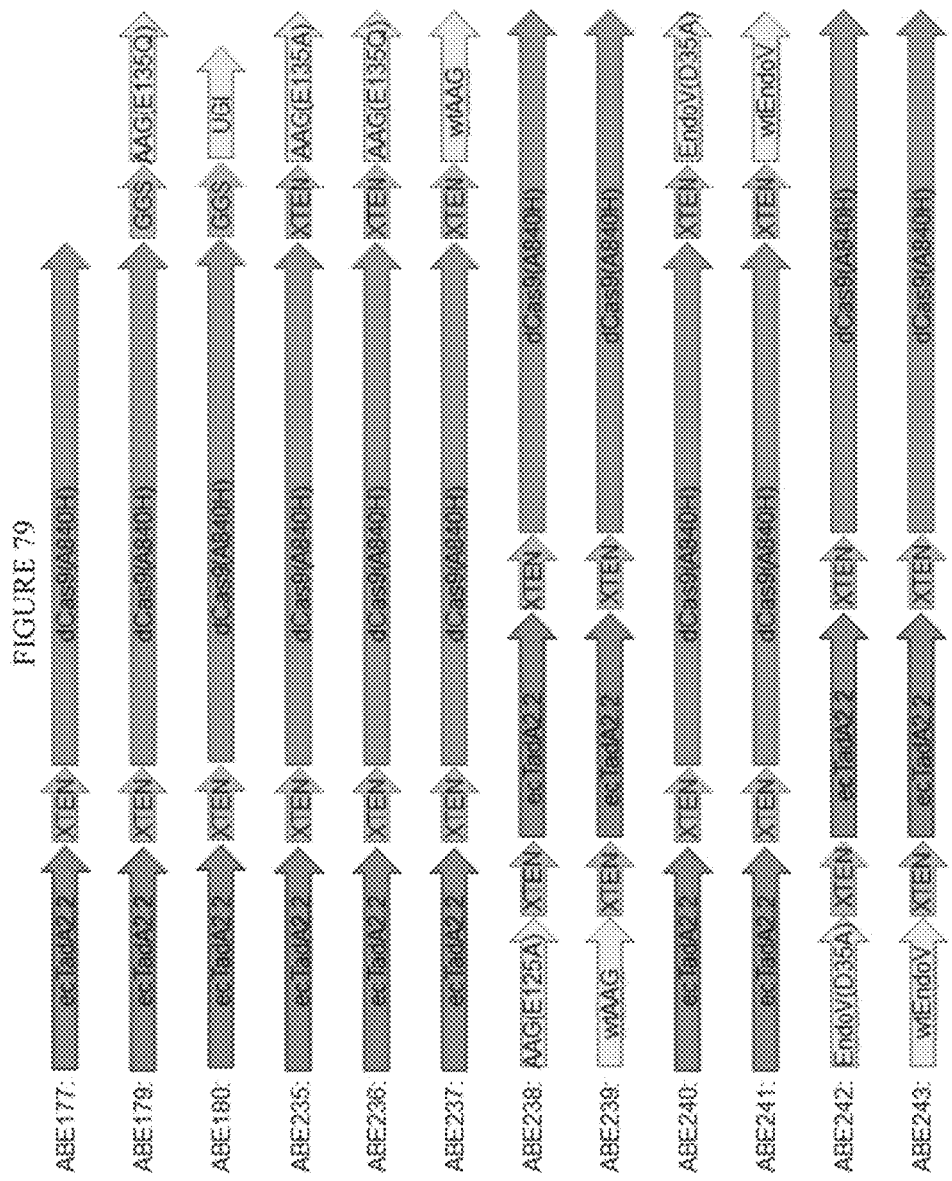
FIG. 79 shows the constructs of all inhibitors tested.
Figures 80, 81:
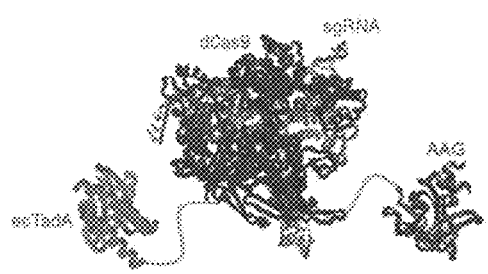
FIG. 80 shows the constructs used when tethering AAG to ABE.
FIG. 81 is a schematic showing the tethering of AAG to ABE.
Figures 82, 83:
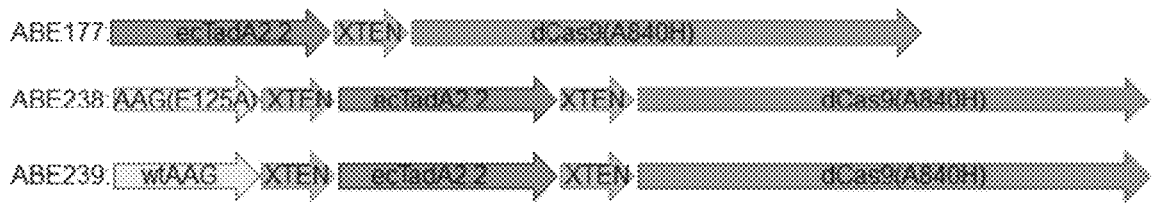
FIG. 82 shows the results of tethering AAG to ABE.
FIG. 83 shows the constructs used when tethering AAG to ABE with an N-terminus of TadA.
Figures 84, 85:
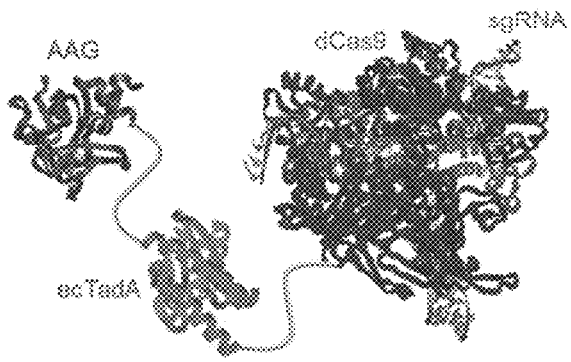
FIG. 84 is a schematic showing the tethering of AAG to ABE with an N-terminus of TadA.
FIG. 85 shows the results of tethering AAG to ABE.
Figure 91:
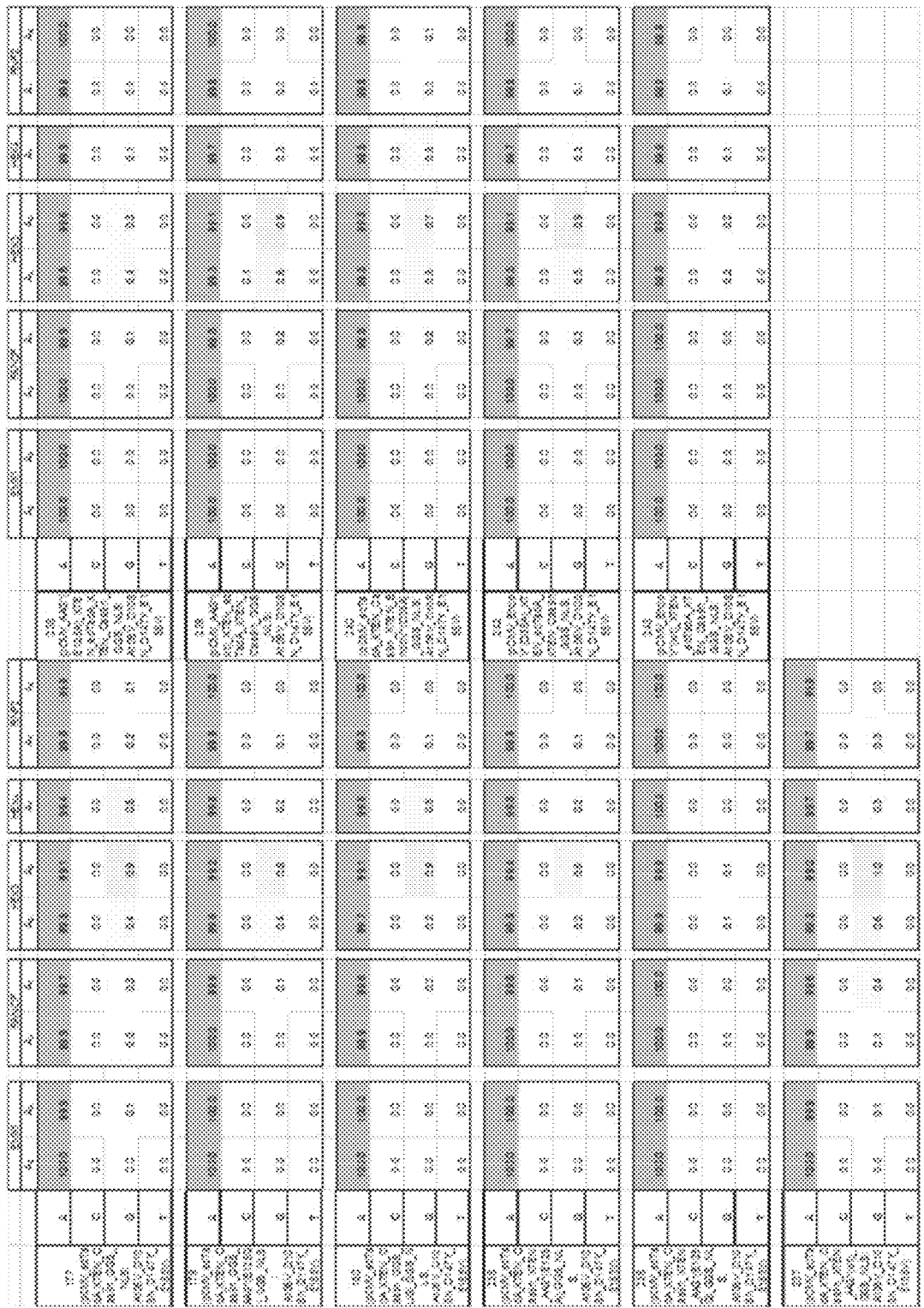
FIG. 91 shows the results of various inhibitors increasing A to G editing.

It has been suggested that dimerization of the deaminase may improve base editing. The current editor architecture, in trans dimerization, and in cis dimerization are shown in FIG. 63 (top structure, bottom left structure, and bottom right structure). Results shown in FIG. 64 through FIG. 66 show that dimerization of the deaminase improved base editing. With respect to the "YAC" sequence specificity, one hypothesis, supported by the data, is that ABE operates best on As in positions 4-6 of the protospacer and with a surrounding sequence of "YAC"; target A underlined, where Y is C or T. Evolving ABE Editor Against New Selection Sequences A next goal was to modify the ABE editor sequence preferences. One ABE targeted the Q4 stop site only and A to G reversion was observed, as shown in FIG. 69. Results also showed that the editor targeted the W15 stop site only and A to G reversion was observed, as shown in FIG. 70. Sequences were different than original evolution target, which was the chloramphenicol active site. New mutations could result in a kinetically faster enzyme. The third round of evolution targeted both Q4 and W15 sites simultaneously in the kanamycin gene. Correction of two sites in the same gene, in addition to targeting sites of with sequence identity dissimilar from the original chloramphenicol gene creates greater selection stringency. The template used for evolution #3 was bacterial plasmid pNMG-288 which contained 2gRNA (targeting Q4 stop and W15 stop in kanamycin). Error-pone PCR was performed on the deaminase portion of pNMG-288 which already contained the following mutations: A106V, D108N, D147Y, E155V.

Upon creating mammalian constructs of the corresponding variants resulting from evolution round #3, it was found that pNMG-341 and pNMG-340 generally out-performed pNMG-290, which was the most highly optimized construct from evolution #2.

TABLE 5

Includes exemplary protospacer and PAM sequences. An RNA sequence complementary to the protospacer sequence in the table would be used in a gRNA to target an ABE to the sequence. The target A with respect to the original Hek-2 site (originally at position 5) is shown in bold, and nucleotides that differ from the original Hek-2 sequence are underlined. The sequences correspond to SEQ ID NOs: 445-464 from top to bottom.

| plasmid name | comment | protospacer sequence | PAM |
| --- | --- | --- | --- |
| pNMG-299 | other sites within HEK2 locus | GAACACAAAGCATAGACTGC | GGG |
| pNMG-301 | other sites within HEK2 locus | GGAACACAAAGCATAGACTG | CGG |
| pNMG-302 | other sites within HEK2 locus | AACACAAAGCATAGACTGCG | GGG |
| pNMG-303 | other sites within HEK2 locus | ACAAAGCATAGACTGCGGGG | CGG |
| pNMG-304 | other sites within HEK2 locus | CAAAGCATAGACTGCGGGGC | GGG |
| pNMG-305 | other sites within HEK2 locus | GTGGTAATTTTCCAGCCCGC | TGG |
| pNMG-306 | other sites within HEK2 locus | CCTTTACAGGGCCAGCGGGC | TGG |
| pNMG-307 | other sites within HEK2 locus | CTGTCACAGTTAGCTCAGCC | AGG |

TABLE 5-continued

Includes exemplary protospacer and PAM sequences. An RNA sequence complementary to the protospacer sequence in the table would be used in a gRNA to target an ABE to the sequence. The target A with respect to the original Hek-2 site (originally at position 5) is shown in bold, and nucleotides that differ from the original Hek-2 sequence are underlined. The sequences correspond to SEQ ID NOs: 445-464 from top to bottom.

| plasmid name | comment | protospacer sequence | PAM |
|---|---|---|---|
| pNMG-308 | other sites within HEK2 locus | GTGTTCCAGTTTCCTTTACA | GGG |
| pNMG-300 | Hek-2 guideSEQ off-target | GAACACAATGCATAGATTGC | CGG |
| pNMG-309 | Hek-2 similar site | GAAAAAAAGCAGAGACTGC | TGG |
| pNMG-310 | Hek-2 similar site | GAATACTAAGCATAGACTCC | AGG |
| pNMG-311 | Hek-2 similar site | GTAAACAAAGCATAGACTGA | GGG |
| pNMG-312 | Hek-2 similar site | GGACACAAAGCTTAGACTCC | AGG |
| pNMG-313 | Hek-2 similar site | CAATACAAAGGATAGACTGC | AGG |
| pNMG-314 | Hek-2 similar site | GAAGACCAAGGATAGACTGC | TGG |
| pNMG-315 | Hek-2 similar site | GAAAACAAATCATTGACTGC | AGG |
| pNMG-316 | Hek-2 similar site | GATCACAAAGCATGGACTGA | AGG |
| pNMG-317 | Hek-2 similar site | GAAAACAAAACATAGAGTGC | TGG |
| pNMG-318 | Hek-2 similar site | GAACATAAAGAATAGAATGA | TGG |

Example 3—Evolution of Adenosine Base Editor Containing the A106V, D108N, D147Y, and E155V Mutations of ecTadA (Evolution #3)

An ecTadA construct with the consensus mutations A106V, D108N, D147Y (pNMG-184) and E155V was mutagenized with error-pone PCR and the resulting ABE library was targeted with 2 separate gRNAs to two different sites in a kanamycin resitance gene which require two A to G reversions (both in premature stop codons) to confer kanamycin resistance. The 2 gRNA/2 target approach was used to increase the stringency of the selection. See FIGS. 96-99. This evolution resulted in the identification of the following new mutations: L84F, H123Y and I157F.

Evolution #3 was performed analogously as evolution number 1 and 2, except bacterial plasmid pNMG-288 was used as a template, mutations in ecTadA (A106V_D108N_D147Y_E155V) and 2 gRNA expressed to target stop codons in selection plasmid pNMG-27-(Q4term+W15term). Libraries were plated on concentrations of kanamycin above the MIC. The most efficient base editor from evolution #3 was pNMG-371, which contains two ecTadA domains comprising the mutations L84F, A106V, D108N, H123Y, D147Y, E155V, and I156F.

Example 4—Evolution of Adenosine Base Editor ecTadA Residues E25, R26, R107, A142, and A143 to Increase Editing Efficiency of Adenine in Non-YAC Sequences (Evolution #4)

An ecTadA bacterial codon-optimized construct with the consensus mutations from evolution #2, A106V, D108N, D147Y and E155V, which is composed of one unit of ecTadA, an XTEN linker, and catalytically inactive Cas9 (dCas9), was mutagenized using NNK primers that target sites in ecTadA (e.g., E25, R26, R107, A142 and A143) to generate a site-saturated ABE library. Residues E25, R26, R107, A142 and A143 of ecTadA are hypothesized to make contact with the tRNA substrate with the wt ecTadA homodimer. For the NNK primers, N is A, T, C, or G, and K is G or T. The primers contain the mutations and are designed to bind at the 5 regions of interest, and a full-length product is obtained using PCR overlap extension protocol and assembled using USER junctions as used previously in the error-prone library assemblies. The 5 residues of ecTadA that were targeted included E25, R26, R107, A142 and A143. A goal of this evolution was to modify the "YAC" sequence preference of the adenosine base editor. In this round of evolution, the library of ABEs was selected against a spectinomycin resistance gene whose target A was presented in a non-YAC context. See FIGS. 101-123. The results from this round of evolution yielded mutations: R26G and A142N.

The ecTadA_2.2 deaminase construct was mutagenized to target active site residue in spectinomycin (T89). The gRNA targeted region:

(SEQ ID NO: 444)
5'-CAATGATGACTTCTACAGCG-3' corresponds to a non "YAC" sequence. The targeted residues and their respective interactions are shown in Table 6.

TABLE 6

Shows the amino acid residues in saTadA and ecTadA responsible for the specifically listed interactions. The size of the library used in evolution #4 is $32^5$, which is the size of the library based on codon frequency.

| S. aureus TadA | E. coli TadA | Interaction |
|---|---|---|
| G22 | E25/R26 | carbonyl H-bond to 3' C tRNA substrate |
| D103 | R107 | carbonyl H-bond with 5' U in tRNA substrate |
| S138 | A142/A143 | carbonyl H-bond with 5' U in tRNA substrate |

The NNK library with ecTadA_2.2 deaminase template was generated from approximately 500 colonies total from plates containing 128, 256, 384 and 512 of ug/mL spectinomycin. The editor constructs were sub-cloned, re-transformed into S1030 with uncorrected spectinomycin T89I selection plasmid and re-challenged with increasing concentrations of spectinomycin to clarify the true positive phenotypes from random reversions. The editing results of the evolution #4 variants (NNK library) at sites HEK-2, HEK2-3, HEK2-6, HEK2-7, HEK2-10, HEK3, and FANCF sites are shown in FIGS. 108 through 122. The evolution #4 variants do not perform better than the evolution #3 variants and do not demonstrate a relaxed substrate specificity with respect to the "YAC" sequence.

The results of the evolution #4 mammalian transfection for sites HEK-2, HEK2-2, HEK2-3, HEK2-6, HEK2-7, and HEK2-10 sites are shown in FIG. 123. The ecTadA evolution round #4 mutations neither improve editing efficiencies nor broadened substrate tolerance.

The evolution #4 template for evolution for the target sites in ecTadA (A106V, D108N, D147Y, E155V) is given in Table 7, which identifies individual clones that were identified.

TABLE 7

Mutations identified in Evolution #4. The template for evolution: ecTadA (A106V, D108N, D147Y, and E155V).

| clone: | 25 E | 26 R | 107 R | 142 A | 143 A |
|---|---|---|---|---|---|
| PLATE 1 | | | | | |
| 1 | M | G | P | N | D |
| 2 | D | G | K | N | G |
| 3 |   | N | A | N |   |
| 4 |   | Q |   | N |   |
| 5 | A | G | N | N | E |
| 6 |   | G | W | N |   |
| 7 |   |   |   | N | L |
| 8 | A | C |   | N | W |
| PLATE 2 | | | | | |
| 9 | D | G | K | N | G |
| 10 | R |   |   | N | L |
| 11 |   |   | H | N | M |
| 12 | M | G | P | N | D |
| 13 |   | Q |   | N |   |
| 14 | M | G |   | N | D |
| 15 |   | L |   | N | L |
| 16 | R |   |   | N | L |
| PLATE 3 | | | | | |
| 17 |   | C | H | N |   |
| 18 |   | G | H | N | G |
| 19 | V | G | S | D | S |
| 20 |   | Q |   | N |   |

TABLE 7-continued

Mutations identified in Evolution #4. The template for evolution: ecTadA (A106V, D108N, D147Y, and E155V).

| clone: | 25 E | 26 R | 107 R | 142 A | 143 A |
|---|---|---|---|---|---|
| 21 | S | C |   | N | Q |
| 22 | Y | K |   | G | R |

Example 5—Evolution of Adenosine Base Editor Containing the L84F, A106V, D108N, H123Y, D147Y, E155V, and I157F Mutations of ecTadA (Evolution #5)

An ecTadA construct containing mutations from evolution #3, L84F, A106V, D108N, H123Y, D147Y, E155V, I157F (pNMG-325) was mutagenized with error-prone PCR and the resulting ABE library was targeted with 2 separate gRNAs to two different loci in two different antibiotic resistant genes: chloramphenicol and spectinomycin. Both target sequences contained a target A in a non-YAC context.

The editor plasmid encodes two different gRNA: chlor and spect, both of which are "non-YAC" targets. The chlor target sequence is (SEQ ID NO: 441)
5'-TACGGCGTAGTGCACCTGGA-3' and has a target "A" at position "9."

The spect target sequence is (SEQ ID NO: 444)
5'-CAATGATGACTTCTACAGCG-3 and has a target "A" at position "6." A schematic of the construct containing ecTadA and dCas9 used for ecTadA evolution (evolution #5) is shown in FIG. 124.

The library was transformed into S1030+selection plasmid, ABE expressed for 7 hours before plating on selection media: 128 ug/mL chloramphenicol (+kan/carb), 128 ug/mL chloramphenicol, 128 ug/mL spectinomycin (+kan/carb), 128 ug/mL chloramphenicol, 256 ug/mL spectinomycin (+kan/carb), 128 ug/mL chloramphenicol, 384 ug/mL spectinomycin (+kan/carb). The results of the clones assayed after fifth evolution #5 are shown in FIGS. 125 through 128. Surviving colonies are shown. The amplicons from spect selection clones assayed after evolution #5 are shown in FIG. 127. All colonies sequenced from double selection plates did not have any new mutations relative to the starting material.

Example 6—Examination of Mutations Introduced into the S. aureus TadA

Mutations were introduced into the *S. aureus* TadA (saTadA) based on the published crystal structure in Losey H. C., et al., "Crystal structure of *Staphylococcus aureus* tRNA adenosine deaminase TadA in complex with RNA," *Nature Structural and Molecular Biology*, 13, p. 153-159 (2006); the entire contents of which are hereby incorporated by reference. Based on the crystal structure of *S. aureus* TadA bound to its native tRNA substrate, 4 residues were selected for mutagenesis which made H-bond contact with the anticodon loop of the substrate. A first goal was to determine whether or not another version of an ABE editor could be made that could induce A to G mutations in DNA. For example, by using a TadA from another bacterial species (e.g., *S. aureus*). A second goal was to determine if the sequence specificity of a *S. aureus* editor was similar or different than the an ecTadA editor. A third goal was to test whether the editing efficiencies of an *S. aureus* ABE editor are improved as compared to an *E. coli* ABE editor. Briefly, mutations D104N, D103A, G22P, and S138A were made in saTadA. See constructs pNMG-345-350 in Table 4. The editing results of base editing at sites HEK-2, HEK2-1, HEK2-2, HEK2-3, HEK2-4, HEK2-6, HEK2-9, HEK2-10, HEK3, RNF2, and FANCF sites are shown in FIGS. 129 through 139. These figures show that mutations identified in ecTadA can be made in S. *Aureus* TadA (saTadA) to confer the ability of saTadA to deaminate adenine in DNA. The figures also show that the YAC sequence preference is similar for saTadA as it is for ecTadA.

Example 7—Testing ecTadA Homodimers Vs Heterodimers and Linker Lengths of Adenosine Base Editors Adenosine base editor constructs were generated to test various linker lengths and various combinations of adenosine deaminase (e.g., wild-type ecTadA and/or mutant ecTadA domains) domains. For each construct the efficiency of mutating a target A to a G was tested. For example, constructs pNMG 492-500 and pNMG-513-518 were tested for their ability to generate A to G mutations in the DNA ofcells. The identities of constructs pNMG 492-500 and pNMG-513-551 are shown in Table 4. Results ofthese tests are shown, for example, in FIGS. 141-149. Further, arginine residues within the adenosine deaminase of base editors were mutated to determine whether they had an effect on target sequence specificity, for example, their ability to mutate an A that is not part of a 5'-YAC-3' sequence, where Y is C or T, was tested. Results of these tests are shown, for example, in FIG. 141.

TABLE 8 sgRNA Plasmid key. The plasmid key below contains the protospacer sequence of the sgRNA sequence and identifies the reference plasmid number and site. For the protospacer sequence, the T is a U in the gRNA. In some embodiments, any of the gRNAs provided herein comprise any of the protospacer sequences in Table 8, where T is U.

| plasmid number | site | protospacer | SEQ ID NO: |
|---|---|---|---|
| pNMG-260 | RNF-multiA | AGAAAAACAATTTTAGTATT | 476 |
| pNMG-261 | HEK3-multiA | GCAGAAATAGACTAATTGCA | 477 |
| pNMG-299 | HEK2 | GAACACAAAGCATAGACTGC | 478 |
| pNMG-300 | HEK2 guideseq | GAACACAATGCATAGATTGC | 479 |
| pNMG-301 | HEK2-2 | GGAACACAAAGCATAGACTG | 480 |
| pNMG-302 | HEK2-3 | AACACAAAGCATAGACTGCG | 481 |
| pNMG-303 | HEK2-4 | ACAAAGCATAGACTGCGGGG | 482 |
| pNMG-304 | HEK2-5 | CAAAGCATAGACTGCGGGGC | 483 |
| pNMG-305 | HEK2-6 | GTGGTAATTTTCCAGCCCGC | 484 |
| pNMG-306 | HEK2-7 | CCTTTACAGGGCCAGCGGGC | 485 |
| pNMG-307 | HEK2-8 | CTGTCACAGTTAGCTCAGCC | 486 |
| pNMG-308 | HEK2-9 | GTGTTCCAGTTTCCTTTACA | 487 |
| pNMG-309 | HEK2 similar 1 | GAAAAAAAGCAGAGACTGC | 488 |
| pNMG-310 | TAC (HEK2 similar 2) | GAATACTAAGCATAGACTCC | 489 |
| pNMG-311 | AAC (HEK2 similar 3) | GTAAACAAAGCATAGACTGA | 490 |
| pNMG-312 | HEK2 similar 4 | GGACACAAAGCTTAGACTCC | 491 |
| pNMG-313 | HEK2 similar 5 | CAATACAAAGGATAGACTGC | 492 |
| pNMG-314 | GAC (HEK2 similar 6) | GAAGACCAAGGATAGACTGC | 493 |
| pNMG-315 | HEK2 similar 7 | GAAAACAAATCATTGACTGC | 494 |
| pNMG-316 | HEK2 similar 8 | GATCACAAAGCATGGACTGA | 495 |
| pNMG-317 | HEK2 similar 9 | GAAAAAAACATAGAGTGC | 496 |
| pNMG-318 | CAT (HEK2 similar 10) | GAACATAAAGAATAGAATGA | 497 |
| pNMG-380 | R1329* SCN1A | AATCAAGATAAGGCTCTTAG | 498 |

TABLE 8-continued sgRNA Plasmid key. The plasmid key below contains the protospacer
sequence of the sgRNA sequence and identifies the reference
plasmid number and site. For the protospacer sequence, the T is a
U in the gRNA. In some embodiments, any of the gRNAs provided herein
comprise any of the protospacer sequences in Table 8, where T is U.

| plasmid number | site | protospacer | SEQ ID NO: |
|---|---|---|---|
| pNMG-423 | R580* SCN1A | GCTCACCCTCTAAAGCTGAAA | 499 |
| pNMG-424 | C136Y PTEN (MDA-MB-415) | GTATATGCATATTTATTACAT | 500 |
| pNMG-425 | Q144* TP53 (NCI-H2171) | GCAGCTACACAGGGCAGGTCT | 501 |
| pNMG-426 | R306* TP53 (HCC1937) | GACCTCACTTAGTGCTCCCTG | 502 |
| pNMG-463 | CAG | GGACAGGCAGCATAGACTGT | 503 |
| pNMG-464 | GAA | GTAGAAAAGTATAGACTGC | 504 |
| pNMG-465 | GAG | GGAGAGAGAGCATAGACTGC | 505 |
| pNMG-466 | GAT | GAAGATAGAGAATAGACTGC | 506 |
| pNMG-467 | TAA | GGCTAAAGACCATAGACTGT | 507 |
| pNMG-468 | TAG | GTCTAGAAAGCTTAGACTGC | 508 |
| pNMG-469 | TAT | GAGTATGAGGCATAGACTGC | 509 |
| pNMG-470 | AAG | GTCAAGAAAGCAGAGACTGC | 510 |
| pNMG-471 | AAT | GGGAATAAATCATAGAATCC | 511 |
| pNMG-472 | CAA | GAGCAAAGACAATACACTGT | 512 |
| pNMG-501 | AAA | GACAAAGAGGAAGAGAGACG | 513 |
| pNMG-502 | SITE 2 | GGGGACGCGCTGGCTTCCCG | 514 |
| pNMG-503 | SITE 3 | GGACCGGCTCCCTGGCGGTC | 515 |
| pNMG-504 | SITE 4 | GCCACTTCTAAGCCCTTGAT | 516 |
| pNMG-505 | SITE 5 | GGGAAAGACCCAGCATCCGT | 517 |
| pNMG-506 | SITE 6 | GCGGTACGCCGCTTCAGTGA | 518 |
| pNMG-507 | SITE 7 | GAAACTGGTCCCGTTTACAG | 519 |
| pNMG-508 | SITE 8 | GATGAGATAATGATGAGTCA | 520 |
| pNMG-509 | SITE 9 | GCCTAGGCAGTGGGGGTGCA | 521 |
| pNMG-510 | R196* TP53 (Calu-6) | GACTCAGATAAGATGCTGAGG | 522 |
| pNMG-511 | M237I TP53 (T98G) | GCATATGTAACAGTTCCTGCA | 523 |
| pNMG-512 | R273H TP53 (NCI-H1975) | GTGCATGTTTGTGCCTGTCC | 524 |
| pNMG-531 | EMX1-5 | GGGGATGGCAGGGCAGGAAG | 525 |
| pNMG-532 | EMX1-6 | GGGTTAGGGGCCCCAGGCCG | 526 |
| pNMG-533 | FANCF-7 | GGATGCAGCTCGTTACCACC | 527 |
| pNMG-534 | FANCF-5 | GCGCACGGTGGCGGGGTCCC | 528 |
| pNMG-535 | HEK3-6 | GGGCCAGGTCCCTCCTCTCC | 529 |
| pNMG-536 | HEK3-7 | GGATTGACCCAGGCCAGGGC | 530 |
| pNMG-537 | HEK4-5 | GATGACAGGCAGGGGCACCG | 531 |
| pNMG-538 | HEK4-6 | GGGCCAGTGAAATCACCCTG | 532 |
| pNMG-539 | RNF2-5 | GGGGACTTTGGGAGGTGATC | 533 |

TABLE 8-continued sgRNA Plasmid key. The plasmid key below contains the protospacer sequence of the sgRNA sequence and identifies the reference plasmid number and site. For the protospacer sequence, the T is a U in the gRNA. In some embodiments, any of the gRNAs provided herein comprise any of the protospacer sequences in Table 8, where T is U.

| plasmid number | site | protospacer | SEQ ID NO: |
|---|---|---|---|
| pNMG-540 | RNF2-6 | GCACCAGCAGATGCAGTGTC | 534 |
| pNMG-601 | RNF2-6 | GACACACACACTTAGAATCTG | 535 |
| pNMG-602 | RNF2-6 | GCACACACACTTAGAATCTGT | 536 |

Example 8—DNA Shuffling Using Nucleotide Exchange and Excision Technology (NExT) to Remove Epistatic Mutations, Evolution #6

To generate more efficient adenosine base editors and remove potential epistatic mutations constructs from evolutions 4, 5a, 5b and 2 were subjected to DNA shuffle experiments using Nucleotide Exchange and Excision Technology (NExT). A schematic representation of DNA shuffling is shown in FIGS. 150 and 151. Briefly, a DNA shuffle library was created. NExT shuffle and USER assembly, were transformed into 10B cells. The isolated DNA shuffle library was transformed into S1030 with selection plasmid. Plating was performed using 4 different selection conditions, including, low chlor, high chlor, high spect, and chlor plus spect after 7 hours of adenosine base editor induction. Incubation was performed at 37 C for 48 hours then colony PCR was performed on survivors. See FIGS. 150 and 151.

The sequence identity of the clones obtained from evolution #6 is shown in FIGS. 152 and 153. The mutations are given relative to SEQ ID NO: 1. FIG. 154 contains schematic representations of base editors derived from evolution #6. Evolution #6 identified mutations in P48 (e.g., P48T, P48S and P48A) and A142 (e.g., A142N), relative to SEQ ID NO: 1. These mutations improved the efficiency of base editors to mutate an A residue to a G in DNA. See, for example, the experimental results in FIGS. 155-158.

Example 9—Evolving Adenosine Base Editors to Efficiently Edit Multi a Sites, Evolution #7

To generate base editors that are more efficient at editing an A within a site containing multiple A residues (e.g., a 5'-AAA-3' sequence), base editors capable of editing a multi-A site were evolved. Evolution was performed by identifying evolved base editors that could correct two point mutations that conferred the ability of cells to be antibiotic (kan) resistant. See, for example, FIGS. 163-165. Mutations that improve base editing efficiency and/or the ability to edit an A at a multi-A site are shown in FIG. 164, where mutations are identified relative to SEQ ID NO: 1. Evolution #7 identified mutations in W23 (e.g., W23R, and W23L) and R152 (e.g., R152P, and R152H), relative to SEQ ID NO: 1. A summary of base editing efficiency for selected adenosine base editor constructs on various target sequences is shown in FIGS. 179-186. Tables 9 and 10 contain bacterial selection plasmid data.

TABLE 9

Bacterial selection plasmid data.

| selection plasmid | corresponding editor + gRNA | modification | protospacer (targeted selection) | position of target A | strand modification | origin | MIC (S1030) Kan |
|---|---|---|---|---|---|---|---|
| pNMG-208 | pNMG-255 | stop in Kan gene, W15 | 5'-GCTTAGGTGGAGCGCCTATT-3' (SEQ ID NO: 707) | 5 | coding | RSF1030 | 32 ug/mL |
| pNMG-209 | pNMG-257 | stop in Kan gene, R18 | 5'-AGTCACTCCACCCAAGCGGC-3' (SEQ ID NO: 708) | 5 | template | RSF1030 | 256 ug/mL |
| pNMG-210 | pNMG-259 | stop in Kan gene, R44 | 5'-GTCACCCCTGCGCTGACAGC-3' (SEQ ID NO: 709) | 4 | template | RSF1030 | 128 ug/mL |
| pNMG-211 | pNMG-253 | stop in Kan gene, Q4 | 5'-ATCTTATTCGATCATGCGAA-3' (SEQ ID NO: 710) | 6 | template | RSF1030 | 16 ug/mL |
| pNMG-212 | n/a | wt Kan gene | control plasmid | n/a | n/a | RSF1030 | >1056 ug/mL |
| pNMG-213 | pNMG-255 | pNMG-208 w/ SD8 RBS | 5'-GCTTAGGTGGAGCGCCTATT-3' (SEQ ID NO: 711) | 5 | template | RSF1030 | 528 ug/mL |
| pNMG-214 | pNMG-255 | pNMG-208 w/ SD3 RBS | 5'-GCTTAGGTGGAGCGCCTATT-3' (SEQ ID NO: 712) | 5 | template | RSF1030 | 128 ug/mL |
| pNMG-215 | pNMG-255 | pNMG-208 w/ SD2 RBS | 5'-GCTTAGGTGGAGCGCCTATT-3' (SEQ ID NO: 713) | 5 | template | RSF1030 | unknonwn |

TABLE 9-continued

Bacterial selection plasmid data.

| selection plasmid | corresponding editor + gRNA | modification | protospacer (targeted selection) | position of target A | strand modification | origin | MIC (S1030) Kan |
|---|---|---|---|---|---|---|---|
| pNMG-216 | n/a | 2 stop, Q4 + R18 | 5'-ATCTTATTCGATCATGCGAA-3' (SEQ ID NO: 714), 5'-AGTCACTCCACCCAAGCGGC-3' (SEQ ID NO: 715) | 6 + 5 | template | RSF1030 | 8 ug/mL |
| pNMG-217 | n/a | 2 stop, W15 + R44 | 5'-GCTTAGGTGGAGCGCCTATT-3' (SEQ ID NO: 716), 5'-GTCACCCCTGCGCTGACAGC-3' (SEQ ID NO: 717) | 5 + 4 | both | RSF1030 | 8 ug/mL |
| pNMG-221 | n/a | 2 stop, W15 + R44 | 5'-GCTTAGGTGGAGCGCCTATT-3' (SEQ ID NO: 718), 5'-GTCACCCCTGCGCTGACAGC-3' (SEQ ID NO: 719) | 5 + 4 | both | CloDF3 | 4 ug/mL |

TABLE 10

Bacterial selection plasmid data

| selection plasmid | corresponding editor + gRNA | original Chlor selection | 5'-TACGGCGTAGTGCACCTGGA-3' (SEQ ID NO: 441) silent mutations in chlor site in italics, bold is target A: | | template | RSF 1030 | MIC (S1030) Chlor 1 ug/mL | SEQ ID NO: |
|---|---|---|---|---|---|---|---|---|
| pNMG-186 | pNMG-197 | original chlor site (H193Y) | 5'-TACTGTGTAATGTATCTGGA-3' | 9 | template | RSF 1030 | 1 ug/mL | 720 |
| pNMG-187 | pNMG-198 | original chlor site (H193Y) | 5'-TACTGCGTAGTGCACCTGGA-3' | 9 | template | RSF 1030 | 1 ug/mL | 721 |
| pNMG-188 | pNMG-199 | original chlor site (H193Y) | 5'-TACCGCGTAGTGCACCTGGA-3' | 9 | template | RSF 1030 | 1 ug/mL | 722 |
| pNMG-189 | pNMG-200 | original chlor site (H193Y) | 5'-TACAGCGTAGTGCACCTGGA-3' | 9 | template | RSF 1030 | 1 ug/mL | 723 |
| pNMG-190 | pNMG-200 | original chlor site (H193Y) | 5'-TACGGCGTAATGCACCTGGA-3' | 9 | template | RSF 1030 | 1 ug/mL | 724 |
| pNMG-191 | pNMG-201 | original chlor site (H193Y) | 5'-TACGGCATAGTGCACCTGGA-3' | 9 | template | RSF 1030 | 1 ug/mL | 725 |
| pNMG-192 | pNMG-202 | original chlor site (H193Y) | 5'-TACGGCGTAGTGTACCTGGA-3' | 9 | template | RSF 1030 | 1 ug/mL | 726 |
| pNMG-193 | pNMG-203 | original chlor site (H193Y) | 5'-TACGGCGTAGTGGACCTGGA-3' | 9 | template | RSF 1030 | 1 ug/mL | 727 |
| pNMG-194 | pNMG-204 | original chlor site (H193Y) | 5'-TACGGCGTAGTGAACCTGGA-3' | 9 | template | RSF 1030 | 1 ug/mL | 728 |
| pNMG-195 | pNMG-205 | original chlor site (H193Y) | 5'-TACGGCGTAGTGCACTTGGA-3' | 9 | template | RSF 1030 | 1 ug/mL | 729 |
| pNMG-196 | pNMG-206 | original chlor site (H193Y) | 5'-CGTAGTGCACCTGGATGGCC-3' | 4 | template | RSF 1030 | 1 ug/mL | 730 |
|  | pNMG-227 | chlor (1)_H193Y | 5'-TACCGCGTAGTGAACTTGGA-3' | 9 |  |  | 1 ug/mL | 731 |
|  | pNMG-228 | chlor (2)_H193Y | 5'-TACCGCATAGTGAACTTGGA-3' | 7 + 9 |  |  | 1 ug/mL | 732 |
|  | corresponding editor + 2 gRNA target Kan only |  |  |  |  |  |  |  |
| pNMG-270 | pNMG-288 | stop in Kan gene, W15STOP | 5'-GCTTAGGTGGAGCGCCTATT-3' | 5 | coding | RSF 1030 |  | 733 |

TABLE 10-continued

Bacterial selection plasmid data

| | | | | | | | |
|---|---|---|---|---|---|---|---|
| | | stop in Kan gene, Q4STOP | 5'-ATCTTATTCGATCATGCGAA-3' | 6 | template | | 734 |
| | | original Chlor selection His193Y | 5'-TACGGCGTAGTGCACCTGGA-3' | 9 | template | | 735 |
| pNMG-319 | | stop in Kan gene, W15STOP | 5'-GCTTAGGTGGAGCGCCTATT-3' | 5 | coding | RSF 1030 | 733 |
| | | stop in Kan gene, Q4STOP | 5'-ATCTTATTCGATCATGCGAA-3' | 6 | template | | 734 |
| | | chlor (2) | 5'-TACCGCATAGTGAACTTGGA-3' | 7 + 9 | template | | 732 |
| pNMG-333 | round 4, evolve against spect only | spect gene: T89I mutation | 5'-CAATGATGACTTCTACAGCG-3' | 6 | template | RSF 1030 | 736 |
| | round 5: chlor + spect round 6: spect + chlor | chlor gene: H193Y mutation | 5'-TACGGCGTAGTGCACCTGGA-3' | 9 | template | | 737 |
| pNMG-570 | round 7, evolve against two mutations, same gene kanamycin (Q4sop and D208N reversion needed) | kan gene D208N mutation | 5'-TTCATTAACTGTGGCCGGCT-3' | 7 | coding | RSF 1030 | 738 |
| | | | 5'-ATCTTATTCGATCATGCGAA-3' | 6 | template | | 739 |

Example 10—Cas9 Variant Sequences

The disclosure provides Cas9 variants, for example Cas9 proteins from one or more organisms, which may comprise one or more mutations (e.g., to generate dCas9 or Cas9 nickase). In some embodiments, one or more of the amino acid residues, identified below by an asterisk, of a Cas9 protein may be mutated. In some embodiments, the D10 and/or H840 residues of the amino acid sequence provided in SEQ ID NO: 52, or a corresponding mutation in any of the amino acid sequences provided in SEQ ID NOs: 108-357, are mutated. In some embodiments, the D10 residue of the amino acid sequence provided in SEQ ID NO: 52, or a corresponding mutation in any of the amino acid sequences provided in SEQ ID NOs: 108-357, is mutated to any amino acid residue, except for D. In some embodiments, the D10 residue of the amino acid sequence provided in SEQ ID NO: 52, or a corresponding mutation in any of the amino acid sequences provided in SEQ ID NOs: 108-357, is mutated to an A. In some embodiments, the H840 residue of the amino acid sequence provided in SEQ ID NO: 52, or a corresponding residue in any of the amino acid sequences provided in SEQ ID NOs: 108-357, is an H. In some embodiments, the H840 residue of the amino acid sequence provided in SEQ ID NO: 52, or a corresponding mutation in any of the amino acid sequences provided in SEQ ID NOs: 108-357, is mutated to any amino acid residue, except for H. In some embodiments, the H840 residue of the amino acid sequence provided in SEQ ID NO: 52, or a corresponding mutation in any of the amino acid sequences provided in SEQ ID NOs: 108-357, is mutated to an A. In some embodiments, the D10 residue of the amino acid sequence provided in SEQ ID NO: 52, or a corresponding residue in any of the amino acid sequences provided in SEQ ID NOs: 108-357, is a D.

A number of Cas9 sequences from various species were aligned to determine whether corresponding homologous amino acid residues of D10 and H840 of SEQ ID NO: 52 or SEQ ID NO: 108 can be identified in other Cas9 proteins, allowing the generation of Cas9 variants with corresponding mutations of the homologous amino acid residues. The alignment was carried out using the NCBI Constraint-based Multiple Alignment Tool (COBALT(accessible at st-va.ncbi.nlm.nih.gov/tools/cobalt), with the following parameters. Alignment parameters: Gap penalties −11,-1; End-Gap penalties −5,-1. CDD Parameters: Use RPS BLAST on; Blast E-value 0.003; Find Conserved columns and Recompute on. Query Clustering Parameters: Use query clusters on; Word Size 4; Max cluster distance 0.8; Alphabet Regular.

An exemplary alignment of four Cas9 sequences is provided below. The Cas9 sequences in the alignment are: Sequence 1 (S1): SEQ ID NO: 108|WP_010922251|gi 499224711|type II CRISPR RNA-guided endonuclease Cas9 [*Streptococcus pyogenes*]; Sequence 2 (S2): SEQ ID NO: 109|WP_039695303|gi 746743737|type II CRISPR RNA-guided endonuclease Cas9 [*Streptococcus gallolyticus*]; Sequence 3 (S3): SEQ ID NO: 110|WP_045635197|gi 782887988|type II CRISPR RNA-guided endonuclease Cas9 [*Streptococcus mitis*]; Sequence 4 (S4): SEQ ID NO: 111|5AXW_A|gi 924443546| *Staphylococcus Aureus* Cas9. The HNH domain (bold and underlined) and the RuvC domain (boxed) are identified for each of the four sequences. Amino acid residues 10 and 840 in S1 and the homologous amino acids in the aligned sequences are identified with an asterisk following the respective amino acid residue.

```
S1    1   --MDKK-YSIGLD*IGTNSVGWAVITDEYKVPSKKFKVLGNTDRHSIKKNLI--GALLFDSG--ETAEATRLKRTARRRYT   73
S2    1   --MTKKNYSIGLD*IGTNSVGWAVITDDYKVPAKKMKVLGNTDKKYIKKNLL--GALLFDSG--ETAEATRLKRTARRRYT   74
S3    1   --M-KKGYSIGLD*IGTNSVGFAVITDDYKVPSKKMKVLGNTDKRFIKKNLL--GALLFDEG--TTAEARRLKRTARRRYT   73
```

-continued
```
S4     1 GSHMKRNYILGLD*IGITSVGYGII--DYET----------------RDVIDAGVRLFKEANVENNEGRRSKRGARRLKR    61

S1    74 RRKNRICYLQEIFSNEMAKVDDSFFHRLEESFLVEEDKKHERHPIFGNIVDEVAYHEKYPTIYHLRKKLVDSTDKADLRL   153
S2    75 RRKNRLRYLQEIFANEIAKVDESFFQRLDESFLTDDDKTFDSHPIFGNKAEEDAYHQKFPTIYHLRKHLADSSEKADLRL   154
S3    74 RRKNRLRYLQEIFSEEMSKVDSSFFHRLDDSFLIPEDKRESKYPIFATLTEEKEYHKQFPTIYHLRKQLADSKEKTDLRL   153
S4    62 RRRHRIQRVKKLI-------------FDYNLLTD-------------------HSELSGINPYEARVKGLSQKLSEEE   107

S1   154 IYLALAHMIKFRGHFLIEGDLNPDNSDVDKLFIQLVQTYNQLFEENPINASGVDAKAILSARLSKSRRLENLIAQLPGEK   233
S2   155 VYLALAHMIKFRGHFLIEGELNAENTDVQKIFADFVGVYNRTFDDSHLSEITVDVASILTEKISKSRRLENLIKYYPTEK   234
S3   154 IYLALAHMIKYRGHFLYEEAFDIKNNDIQKIFNEFISIYDNTFEGSSLSGQNAQVEAIFTDKISKSAKRERVLKLFPDEK   233
S4   108 FSAALLHLAKRRG-------------------VHNVNEVEEDT-----------------------------------   131

S1   234 KNGLFGNLIALSLGLTPNFKSNFDLAEDAKLQLSKDTYDDDLDNLLAQIGDQYADLFLAAKNLSDAILLSDILRVNTEIT   313
S2   235 KNTLFGNLIALALGLQPNFKTNFKLSEDAKLQFSKDTYEEDLEELLGKIGDDYADLFTSAKNLYDAILLSGILTVDDNST   314
S3   234 STGLFSEFLKLIVGNQADFKKHFDLEDKAPLQFSKDTYDEDLENLLGQIGDDFTDLFVSAKKLYDAILLSGILTVTDPST   313
S4   132 -----GNELS------------TKEQISRN------------------------------------------------   144

S1   314 KAPLSASMIKRYDEHHQDLTLLKALVRQQLPEKYKEIFFDQSKNGYAGYIDGGASQEEFYKFIKPILEKM--DGTEELLV   391
S2   315 KAPLSASMIKRYVEHHEDLEKLKEFIKANKSELYHDIFKDKNKNGYAGYIENGVKQDEFYKYLKNILSKIKIDGSDYFLD   394
S3   314 KAPLSASMIERYENHQNDLAALKQFIKNNLPEKYDEVFSDQSKDGYAGYIDGKTTQETFYKYIKNLLSKF--EGTDYFLD   391
S4   145 ----SKALEEKYVAELQ---------------------------------------LERLKKDG------   165

S1   392 KLNREDLLRKQRTFDNGSIPHQIHLGELHAILRRQEDFYPFLKDNREKIEKILTFRIPYYVGPLARGNSRFAWMTRKSEE   471
S2   395 KIEREDFLRKQRTFDNGSIPHQIHLQEMHAILRRQGDYYPFLKEKQDRIEKILTFRIPYYVGPLVRKDSRFAWAEYRSDE   474
S3   392 KIEREDFLRKQRTFDNGSIPHQIHLQEMNAILRRQGEYYPFLKDNKEKIEKILTFRIPYYVGPLARGNRDFAWLTRNSDE   471
S4   166 --EVRGSINRFKTSD--------YVKEAKQLLKVQKAYHQLDQSFIDTYIDLLETRRTYYEGP--GEGSPFGW------K   227

S1   472 TITPWNFEEVVDKGASAQSFIERMTNFDKNLPNEKVLPKHSLLYEYFTVYNELTKVKYVTEGMRKPAFLSGEQKKAIVDL   551
S2   475 KITPWNFDKVIDKEKSAEKFITRMTLNDLYLPEEKVLPKHSHVYETYAVYNELTKIKYVNEQGKE-SFFDSNMKQEIFDH   553
S3   472 AIRPWNFEEIVDKASSAEDFINKMTNYDLYLPEEKVLPKHSLLYETFAVYNELTKVKFIAEGLRDYQFLDSGQKKQIVNQ   551
S4   228 DIKEW--------------YEMLMGHCTYFPEELRSVKYAYNADLYNALNDLNNLVITRDENEK---LEYYEKFQIIEN   289

S1   552 LFKTNRKVTVKQLKEDYFKKIECFDSVEISGVEDR---FNASLGTYHDLLKIIKDKDELDNEENEDILEDIVLTLTLFED   628
S2   554 VFKENRKVTKEKLLNYLNKEFPEYRIKDLIGLDKENKSFNASLGTYHDLLKIL-DKAFLDDKVNEEVIEDIIKTLTLFED   632
S3   552 LFKENRKVTEKDIIHYLHN-VDGYDGIELKGIEKQ---FNASLSTYHDLLKIKDKEFMDDAKNEAILENIVHTLTIFED   627
S4   290 VFKQKKKPTLKQIAKEILVNEEDIKGYRVTSTGKPEF---TNLKVYHDIKDITARKEII---ENAELLDQIAKILTIYQS   363

S1   629 REMIEERLKTYAHLFDDKVMKQLKR-RRYTGWGRLSRKLINGIRDKQSGKTILDFLKSDGFANRNFMQLIHDDSLTFKED   707
S2   633 KDMIHERLQKYSDIFTANQLKKLER-RHYTGWGRLSRKLINGIRRNKENNKTILDYLIDDGSANRFNMQLINDDTLPFKQI   711
S3   628 REMIKQRLAQYDSLFDEKVIKALTR-RHYTGWGKLSAKLINGICDKQTGNTILDYLIDDGKINRFNMQLINDDGLSFKEI   706
S4   364 SEDIQEELTNLNSELTQEEIEQISNLKGYTGTHNLSLKAINLILDE------LWHTNDNQIAIFNRLKLVP--------   428

S1   708 IQKAQVSGQGDSLEEIANLAGSPAIKKGILQTVKVVDELVKVMGREKPENIVIEMA RENQTT------QKGQKNSRERM   781
S2   712 IQKSQVVGDVDDIEAVVEDLPGSPAIKKGILQSKIVDELVKVMG-GNPDNIVIEMA RENQTT------NRGRSQSQQRL   784
S3   707 IQKAQVIGKTDDVKQVVQELSSPSIKIVDELVKVMG-EAPESIVIEMA RENQTT------ARGKKNSQQRY   779
S4   429 -KKVDLSQQKEIPTTLVDDFILSPVVKRSFIQSIKVINAIIKKYG-LPNDIIIELA REKNSKDAQKMINEMQKRNRQTN   505

S1   782 KRIEEGIKELGSQIL-------KEHPVENTQLQNEKLYLYYLQNGRDMYVDQELDINRLSD----YDVDH*IVPQSFLKDD   850
S2   785 KKLQNSLKELGSNILNEEKPSYIEDKVENSHLQNDQLFLYYIQNGKDMYTGDELDIDHLSD----YDIDH*IIPQAFIKDD   860
S3   780 KRIEDSLKILASGL---DSNILKENPTDNNQLQNDRLFLYYLNGKDMYTGEALDINQLSS----YDIDH*IIPQAFIKDD   852
S4   506 ERIEEIIRTTGK-----------ENAKYLIEKIKLHDMQEGKCLYSLEAIPLEDLLNNPFNYEVDH*IIPRSVSFDN   570

S1   851 SIDNKVLTRSDKNRGKSDNVPSEEVVKKMKNYWRQLLNAKLITQRKFDN-LTKAERGGL-SELD------KAGFIKRQLV   922
S2   861 SIDNRVLTSSAKNRGKSDDVPSLDIVRARKAEWVRLYKSGLISKRKFDN-LTKAERGGL-TEAD------KAGFIKRQLV   932
S3   853 SLDNRVLTSSKDNRGKSDNVPSIEVVQRKKAFWQQLLDSKLISERKENN-LTKAERGGL-DERD------KVGFIKRQLV   924
S4   571 SFNNKVLVKQEEASKKGNRTPFQYLSSSDSKISYETFKKHILNLAKGKGRISKTKKEYLLEERDINRFSVQKDFINRNLV   650

S1   923 ETRQITKHVAQILDSRMNTKYDENDKLIREVKVITLKSKLVSDFRKDFQFYKVREINNYHHAHDAYLNAVVGTALIKKYP  1002
S2   933 ETRQITKHVAQILDARFNTEHDENDKVIRDVKVITLKSNLVSQFRKDFEFYKVREINDYHEAHDAYLNAVVGTALLKKYP  1012
S3   925 ETRQITKHVAQILDARYNTEVNDKKNRTVKIITLKSNLVSNFRKEFRLYKVREINDYHEEAHDAYLNAVVGTAKAILKKYP  1004
S4   651 DTRYATRGLMNLLRSYFRVN------NLDVKVKSINGGFTSFLRRKWKFKKERNGKYEEAEDALIIA----------   712

S1  1003 KLESEFVYGDYKVYDVRKMIAKSEQ--EIGKATAKYFFYSNIMNFFKTEITLANGEIRKRPLIETNGETGEIVWDKG---  1077
S2  1013 KLASEBFVYGEYKYDIRKPFITNSSD----KATAKYFFYSNLMNFFKTKVKYADGTVFERPIIETNAD-GEIAWNKQ---  1083
S3  1005 KLEPEFVYGEYQKYDLKRYTSRSKDPKEVEKATEKYFFYSNLNFFKEBVYADGTIVKRENIBYSKDTGEIATWNKE--   1081
S4   713 --NADFIFKEWKKLDKAKKVMENQM-------------------FEEKQAESMPEIETEQEYKEIFITPEQIK        764

S1  1078 -----RDFATVRKVLSMPQVNIVKKTEVQT GGFSKESILPKRNSDKLIARKKD---WDPKKYGGFDSPTVAYSVLVVAKV  1149
S2  1084 -----IDFEKVRKVLSYPQVNIVKKETQT  GGFSKESILPKGDSDKLIPRKTKKVYWDTKKYGGFDSPTVAYSVFVVADV  1158
S3  1082 -----KDFAIIKKVLSLPQVNIVKKREVQT GGFSKESILPKGNSDKLIPRKTKDILLDTTKYGGFDSPVIAYSILLIADI  1156
S4   765 EIKDFPKDYKYSERVDKKPNRELINDTLYST RKDDKGNTLIVNNLNGLYDKDNDKL----KKLIN-KSP----EKLLMYHH   835

S1  1150 EKGKSKKLKSVKELLGITIMERSSFEKNPI-DFLEAKG-----YKEVKKDLIIKLPKYSLFELENGRKRMLASAGELQKG  1223
S2  1159 EKGKAKKLKTVKELVGISIMERSSFFEENPV-EFLENKG-----YHNIREDKLIKLPKYSLFEFEGGRRRLLASASELQKG  1232
S3  1157 EKGKAKKLKTVKTLVGITIMEKAAFEENPI-TFLENKG-----YHNVRKENICLPKYSLFELENGRRRLLASAKELQKG  1230
S4   836 DPQTYQKLK--------LIMEQYGDEKNPLYKYYEETGNYLTKYSKKDNGPVIKKIKYYGNKLNAHLDITDDYPNSRNKV   907

S1  1224 NELALPSKYVNFLYLASHYEKLKGSPEDNEQKQLFVEQHKYLDEIIEQISEFSKRVILADANLDKVLSAYNKH------  1297
S2  1233 NEMVLPGYLVELLYHAHRADNF-----NSTEYLNYVSEHKKEFEKVLSCVEDFANLYVDVEKNLSKIRAVADSM------  1301
S3  1231 NEIVLPVYLTTLLYHSKNVHKL-----DEPGHLEYIQKHRNEFKDLLNLVSEFSQKYVLADANLEKIKSLYADN------  1299
S4   908 VKLSLKPYRFD-VYLDNGVYKFV-----TVKNLDVIK--KENYYEVNSKAYEEAKKLKKISNQAEFIASFYNNDLIKING   979
```

```
S1  1298  RDKPIREQAENIIHLFTLTNLGAPAAFKYFDTTIDRKRYTSTKEVLDATLIHQSIT--------GLYETRI----DLSQL  1365
S2  1302  DNFSIEEISNSFINLLTLTALGAPADFNFLGEKIPRKRYTSTKECLNATLIHQSIT--------GLYETRI----DLSKL  1369
S3  1300  EQADIEILANSFINLLTFTALGAPAAFKFFGKDIDRKRYTTVSEILNATLIHQSIT--------GLYETWI----DLSKL  1367
S4   980  ELYRVIGVNNDLLNRIEVNMIDITYR-EYLENMNDKRPPRIIKTIASKT---QSIKKYSTDILGNLYEVKSKKHPQIIKK  1055

S1  1366  GGD  1368
S2  1370  GEE  1372
S3  1368  GED  1370
S4  1056  G--  1056
```

The alignment demonstrates that amino acid sequences and amino acid residues that are homologous to a reference Cas9 amino acid sequence or amino acid residue can be identified across Cas9 sequence variants, including, but not limited to Cas9 sequences from different species, by identifying the amino acid sequence or residue that aligns with the reference sequence or the reference residue using alignment programs and algorithms known in the art. This disclosure provides Cas9 variants in which one or more of the amino acid residues identified by an asterisk in SEQ ID NOs: 108-111 (e.g., S1, S2, S3, and S4, respectively) are mutated as described herein. The residues D10 and H840 in Cas9 of SEQ ID NO: 52 that correspond to the residues identified in SEQ ID NOs: 108-111 by an asterisk are referred to herein as "homologous" or "corresponding" residues. Such homologous residues can be identified by sequence alignment, e.g., as described above, and by identifying the sequence or residue that aligns with the reference sequence or residue. Similarly, mutations in Cas9 sequences that correspond to mutations identified in SEQ ID NO: 52 herein, e.g., mutations of residues 10, and 840 in SEQ ID NO: 52, are referred to herein as "homologous" or "corresponding" mutations. For example, the mutations corresponding to the D10A mutation in SEQ ID NO: 52 or S1 (SEQ ID NO: 108) for the four aligned sequences above are D11A for S2, D10A for S3, and D13A for S4; the corresponding mutations for H840A in SEQ ID NO: 52 or S1 (SEQ ID NO: 108) are H850A for S2, H842A for S3, and H560A for S4.

A total of 250 Cas9 sequences (SEQ ID NOs: 108-357) from different species were aligned using the same algorithm and alignment parameters outlined above. Amino acid residues homologous to residues 10, and 840 of SEQ ID NO: 52 were identified in the same manner as outlined above. The alignments are provided below. The HNH domain (bold and underlined) and the RuvC domain (boxed) are identified for each of the four sequences. Single residues corresponding to amino acid residues 10, and 840 in SEQ ID NO: 52 are boxed in SEQ ID NO: 108 in the alignments, allowing for the identification of the corresponding amino acid residues in the aligned sequences.

```
WP_010922251.1 type II CRISPR RNA-guided endonuclease Cas9 [Streptococcus pyogenes] SEQ ID NO: 108

WP_039695303.1 type II CRISPR RNA-guided endonuclease Cas9 [Streptococcus gallolyticus] SEQ ID NO: 109

WP_045635197.1 type II CRISPR RNA-guided endonuclease Cas9 [Streptococcus mitis] SEQ ID NO: 110

5AXW_A         Cas9, Chain A, Crystal Structure [Staphylococcus Aureus] SEQ ID NO: 111

WP_009880683.1 type II CRISPR RNA-guided endonuclease Cas9 [Streptococcus pyogenes] SEQ ID NO: 112

WP_010922251.1 type II CRISPR RNA-guided endonuclease Cas9 [Streptococcus pyogenes] SEQ ID NO: 113

WP_011054416.1 type II CRISPR RNA-guided endonuclease Cas9 [Streptococcus pyogenes] SEQ ID NO: 114

WP_011284745.1 type II CRISPR RNA-guided endonuclease Cas9 [Streptococcus pyogenes] SEQ ID NO: 115

WP_011285506.1 type II CRISPR RNA-guided endonuclease Cas9 [Streptococcus pyogenes] SEQ ID NO: 116

WP_011527619.1 type II CRISPR RNA-guided endonuclease Cas9 [Streptococcus pyogenes] SEQ ID NO: 117

WP_012560673.1 type II CRISPR RNA-guided endonuclease Cas9 [Streptococcus pyogenes] SEQ ID NO: 118

WP_014407541.1 type II CRISPR RNA-guided endonuclease Cas9 [Streptococcus pyogenes] SEQ ID NO: 119

WP_020905136.1 type II CRISPR RNA-guided endonuclease Cas9 [Streptococcus pyogenes] SEQ ID NO: 120

WP_023080005.1 type II CRISPR RNA-guided endonuclease Cas9 [Streptococcus pyogenes] SEQ ID NO: 121

WP_023610282.1 type II CRISPR RNA-guided endonuclease Cas9 [Streptococcus pyogenes] SEQ ID NO: 122

WP_030125963.1 type II CRISPR RNA-guided endonuclease Cas9 [Streptococcus pyogenes] SEQ ID NO: 123

WP_030126706.1 type II CRISPR RNA-guided endonuclease Cas9 [Streptococcus pyogenes] SEQ ID NO: 124

WP_031488318.1 type II CRISPR RNA-guided endonuclease Cas9 [Streptococcus pyogenes] SEQ ID NO: 125

WP_032460140.1 type II CRISPR RNA-guided endonuclease Cas9 [Streptococcus pyogenes] SEQ ID NO: 126

WP_032461047.1 type II CRISPR RNA-guided endonuclease Cas9 [Streptococcus pyogenes] SEQ ID NO: 127

WP_032462016.1 type II CRISPR RNA-guided endonuclease Cas9 [Streptococcus pyogenes] SEQ ID NO: 128
```

-continued

```
WP_032462936.1 type II CRISPR RNA-guided endonuclease Cas9 [Streptococcus pyogenes] SEQ ID NO: 129

WP_032464890.1 type II CRISPR RNA-guided endonuclease Cas9 [Streptococcus pyogenes] SEQ ID NO: 130

WP_033888930.1 type II CRISPR RNA-guided endonuclease Cas9 [Streptococcus pyogenes] SEQ ID NO: 131

WP_038431314.1 type II CRISPR RNA-guided endonuclease Cas9 [Streptococcus pyogenes] SEQ ID NO: 132

WP_038432938.1 type II CRISPR RNA-guided endonuclease Cas9 [Streptococcus pyogenes] SEQ ID NO: 133

WP_038434062.1 type II CRISPR RNA-guided endonuclease Cas9 [Streptococcus pyogenes] SEQ ID NO: 134

BAQ51233.1      CRISPR-associated protein, Csn1 family [Streptococcus pyogenes] SEQ ID NO: 135

KGE60162.1      hypothetical protein MGAS2111_0903 [Streptococcus pyogenes MGAS2111] SEQ ID NO: 136

KGE60856.1      CRISPR-associated endonuclease protein [Streptococcus pyogenes SS1447] SEQ ID NO: 137

WP_002989955.1 MULTISPECIES: type II CRISPR RNA-guided endonuclease Cas9 [Streptococcus] SEQ ID NO: 138

WP_003030002.1 MULTISPECIES: type II CRISPR RNA-guided endonuclease Cas9 [Streptococcus] SEQ ID NO: 139

WP_003065552.1 MULTISPECIES: type II CRISPR RNA-guided endonuclease Cas9 [Streptococcus] SEQ ID NO: 140

WP_001040076.1 type II CRISPR RNA-guided endonuclease Cas9 [Streptococcus agalactiae] SEQ ID NO: 141

WP_001040078.1 type II CRISPR RNA-guided endonuclease Cas9 [Streptococcus agalactiae] SEQ ID NO: 142

WP_001040080.1 type II CRISPR RNA-guided endonuclease Cas9 [Streptococcus agalactiae] SEQ ID NO: 143

WP_001040081.1 type II CRISPR RNA-guided endonuclease Cas9 [Streptococcus agalactiae] SEQ ID NO: 144

WP_001040083.1 type II CRISPR RNA-guided endonuclease Cas9 [Streptococcus agalactiae] SEQ ID NO: 145

WP_001040085.1 type II CRISPR RNA-guided endonuclease Cas9 [Streptococcus agalactiae] SEQ ID NO: 146

WP_001040087.1 type II CRISPR RNA-guided endonuclease Cas9 [Streptococcus agalactiae] SEQ ID NO: 147

WP_001040088.1 type II CRISPR RNA-guided endonuclease Cas9 [Streptococcus agalactiae] SEQ ID NO: 148

WP_001040089.1 type II CRISPR RNA-guided endonuclease Cas9 [Streptococcus agalactiae] SEQ ID NO: 149

WP_001040090.1 type II CRISPR RNA-guided endonuclease Cas9 [Streptococcus agalactiae] SEQ ID NO: 150

WP_001040091.1 type II CRISPR RNA-guided endonuclease Cas9 [Streptococcus agalactiae] SEQ ID NO: 151

WP_001040092.1 type II CRISPR RNA-guided endonuclease Cas9 [Streptococcus agalactiae] SEQ ID NO: 152

WP_001040094.1 type II CRISPR RNA-guided endonuclease Cas9 [Streptococcus agalactiae] SEQ ID NO: 153

WP_001040095.1 type II CRISPR RNA-guided endonuclease Cas9 [Streptococcus agalactiae] SEQ ID NO: 154

WP_001040096.1 type II CRISPR RNA-guided endonuclease Cas9 [Streptococcus agalactiae] SEQ ID NO: 155

WP_001040097.1 type II CRISPR RNA-guided endonuclease Cas9 [Streptococcus agalactiae] SEQ ID NO: 156

WP_001040098.1 type II CRISPR RNA-guided endonuclease Cas9 [Streptococcus agalactiae] SEQ ID NO: 157

WP_001040099.1 type II CRISPR RNA-guided endonuclease Cas9 [Streptococcus agalactiae] SEQ ID NO: 158

WP_001040100.1 type II CRISPR RNA-guided endonuclease Cas9 [Streptococcus agalactiae] SEQ ID NO: 159

WP_001040104.1 type II CRISPR RNA-guided endonuclease Cas9 [Streptococcus agalactiae] SEQ ID NO: 160

WP_001040105.1 type II CRISPR RNA-guided endonuclease Cas9 [Streptococcus agalactiae] SEQ ID NO: 161

WP_001040106.1 type II CRISPR RNA-guided endonuclease Cas9 [Streptococcus agalactiae] SEQ ID NO: 162

WP_001040107.1 type II CRISPR RNA-guided endonuclease Cas9 [Streptococcus agalactiae] SEQ ID NO: 163

WP_001040108.1 type II CRISPR RNA-guided endonuclease Cas9 [Streptococcus agalactiae] SEQ ID NO: 164

WP_001040109.1 type II CRISPR RNA-guided endonuclease Cas9 [Streptococcus agalactiae] SEQ ID NO: 165

WP_001040110.1 type II CRISPR RNA-guided endonuclease Cas9 [Streptococcus agalactiae] SEQ ID NO: 166

WP_015058523.1 type II CRISPR RNA-guided endonuclease Cas9 [Streptococcus agalactiae] SEQ ID NO: 167

WP_017643650.1 type II CRISPR RNA-guided endonuclease Cas9 [Streptococcus agalactiae] SEQ ID NO: 168
```

-continued

```
WP_017647151.1  type II CRISPR RNA-guided endonuclease Cas9 [Streptococcus agalactiae] SEQ ID NO: 169

WP_017648376.1  type II CRISPR RNA-guided endonuclease Cas9 [Streptococcus agalactiae] SEQ ID NO: 170

WP_017649527.1  type II CRISPR RNA-guided endonuclease Cas9 [Streptococcus agalactiae] SEQ ID NO: 171

WP_017771611.1  type II CRISPR RNA-guided endonuclease Cas9 [Streptococcus agalactiae] SEQ ID NO: 172

WP_017771984.1  type II CRISPR RNA-guided endonuclease Cas9 [Streptococcus agalactiae] SEQ ID NO: 173

CFQ25032.1      CRISPR-associated protein [Streptococcus agalactiae] SEQ ID NO: 174

CFV16040.1      CRISPR-associated protein [Streptococcus agalactiae] SEQ ID NO: 175

KLJ37842.1      CRISPR-associated protein Csn1 [Streptococcus agalactiae] SEQ ID NO: 176

KLJ72361.1      CRISPR-associated protein Csn1 [Streptococcus agalactiae] SEQ ID NO: 177

KLL20707.1      CRISPR-associated protein Csn1 [Streptococcus agalactiae] SEQ ID NO: 178

KLL42645.1      CRISPR-associated protein Csn1 [Streptococcus agalactiae] SEQ ID NO: 179

WP_047207273.1  type II CRISPR RNA-guided endonuclease Cas9 [Streptococcus agalactiae] SEQ ID NO: 180

WP_047209694.1  type II CRISPR RNA-guided endonuclease Cas9 [Streptococcus agalactiae] SEQ ID NO: 181

WP_050198062.1  type II CRISPR RNA-guided endonuclease Cas9 [Streptococcus agalactiae] SEQ ID NO: 182

WP_050201642.1  type II CRISPR RNA-guided endonuclease Cas9 [Streptococcus agalactiae] SEQ ID NO: 183

WP_050204027.1  type II CRISPR RNA-guided endonuclease Cas9 [Streptococcus agalactiae] SEQ ID NO: 184

WP_050881965.1  type II CRISPR RNA-guided endonuclease Cas9 [Streptococcus agalactiae] SEQ ID NO: 185

WP_050886065.1  type II CRISPR RNA-guided endonuclease Cas9 [Streptococcus agalactiae] SEQ ID NO: 186

AHN30376.1      CRISPR-associated protein Csn1 [Streptococcus agalactiae 138P] SEQ ID NO: 187

EAO78426.1      reticulocyte binding protein [Streptococcus agalactiae H36B] SEQ ID NO: 188

CCW42055.1      CRISPR-associated protein, SAG0894 family [Streptococcus agalactiae ILRI112]
                SEQ ID NO: 189

WP_003041502.1  type II CRISPR RNA-guided endonuclease Cas9 [Streptococcus anginosus] SEQ ID NO: 190

WP_037593752.1  type II CRISPR RNA-guided endonuclease Cas9 [Streptococcus anginosus] SEQ ID NO: 191

WP_049516684.1  CRISPR-associated protein Csn1 [Streptococcus anginosus] SEQ ID NO: 192

GAD46167.1      hypothetical protein ANG6_0662 [Streptococcus anginosus T5] SEQ ID NO: 193

WP_018363470.1  type II CRISPR RNA-guided endonuclease Cas9 [Streptococcus caballi] SEQ ID NO: 194

WP_003043819.1  type II CRISPR RNA-guided endonuclease Cas9 [Streptococcus canis] SEQ ID NO: 195

WP_006269658.1  type II CRISPR RNA-guided endonuclease Cas9 [Streptococcus constellatus] SEQ ID NO: 196

WP_048800889.1  type II CRISPR RNA-guided endonuclease Cas9 [Streptococcus constellatus] SEQ ID NO: 197

WP_012767106.1  type II CRISPR RNA-guided endonuclease Cas9 [Streptococcus dysgalactiae] SEQ ID NO: 198

WP_014612333.1  type II CRISPR RNA-guided endonuclease Cas9 [Streptococcus dysgalactiae] SEQ ID NO: 199

WP_015017095.1  type II CRISPR RNA-guided endonuclease Cas9 [Streptococcus dysgalactiae] SEQ ID NO: 200

WP_015057649.1  type II CRISPR RNA-guided endonuclease Cas9 [Streptococcus dysgalactiae] SEQ ID NO: 201

WP_048327215.1  type II CRISPR RNA-guided endonuclease Cas9 [Streptococcus dysgalactiae] SEQ ID NO: 202

WP_049519324.1  CRISPR-associated protein Csn1 [Streptococcus dysgalactiae] SEQ ID NO: 203

WP_012515931.1  type II CRISPR RNA-guided endonuclease Cas9 [Streptococcus equi] SEQ ID NO: 204

WP_021320964.1  type II CRISPR RNA-guided endonuclease Cas9 [Streptococcus equi] SEQ ID NO: 205

WP_037581760.1  type II CRISPR RNA-guided endonuclease Cas9 [Streptococcus equi] SEQ ID NO: 206

WP_004232481.1  type CRISPR RNA-guided endonuclease Cas9 [Streptococcus equinus] SEQ ID NO: 207

WP_009854540.1  type II CRISPR RNA-guided endonuclease Cas9 [Streptococcus gallolyticus] SEQ ID NO: 208
```

-continued

```
WP_012962174.1  type II CRISPR RNA-guided endonuclease Cas9 [Streptococcus gallolyticus] SEQ ID NO: 209

WP_039695303.1  type II CRISPR RNA-guided endonuclease Cas9 [Streptococcus gallolyticus] SEQ ID NO: 210

WP_014334983.1  type II CRISPR RNA-guided endonuclease Cas9 [Streptococcus infantarius] SEQ ID NO: 211

WP_003099269.1  type II CRISPR RNA-guided endonuclease Cas9 [Streptococcus iniae] SEQ ID NO: 212

AHY15608.1      CRISPR-associated protein Csn1 [Streptococcus iniae] SEQ ID NO: 213

AHY17476.1      CRISPR-associated protein Csn1 [Streptococcus iniae] SEQ ID NO: 214

ESR09100.1      hypothetical protein IUSA1_08595 [Streptococcus iniae IUSA1] SEQ ID NO: 215

AGM98575.1      CRISPR-associated protein Cas9/Csn1, subtype II/NMEMI [Streptococcus iniae SF1]
                SEQ ID NO: 216

ALF27331.1      CRISPR-associated protein Csn1 [Streptococcus intermedius] SEQ ID NO: 217

WP_018372492.1  type II CRISPR RNA-guided endonuclease Cas9 [Streptococcus massiliensis] SEQ ID NO: 218

WP_045618028.1  type II CRISPR RNA-guided endonuclease Cas9 [Streptococcus mitis] SEQ ID NO: 219

WP_045635197.1  type II CRISPR RNA-guided endonuclease Cas9 [Streptococcus mitis] SEQ ID NO: 220

WP_002263549.1  type II CRISPR RNA-guided endonuclease Cas9 [Streptococcus mutans] SEQ ID NO: 221

WP_002263887.1  type II CRISPR RNA-guided endonuclease Cas9 [Streptococcus mutans] SEQ ID NO: 222

WP_002264920.1  type II CRISPR RNA-guided endonuclease Cas9 [Streptococcus mutans] SEQ ID NO: 223

WP_002269043.1  type II CRISPR RNA-guided endonuclease Cas9 [Streptococcus mutans] SEQ ID NO: 224

WP_002269448.1  type II CRISPR RNA-guided endonuclease Cas9 [Streptococcus mutans] SEQ ID NO: 225

WP_002271977.1  type II CRISPR RNA-guided endonuclease Cas9 [Streptococcus mutans] SEQ ID NO: 226

WP_002272766.1  type II CRISPR RNA-guided endonuclease Cas9 [Streptococcus mutans] SEQ ID NO: 227

WP_002273241.1  type II CRISPR RNA-guided endonuclease Cas9 [Streptococcus mutans] SEQ ID NO: 228

WP_002275430.1  type II CRISPR RNA-guided endonuclease Cas9 [Streptococcus mutans] SEQ ID NO: 229

WP_002276448.1  type II CRISPR RNA-guided endonuclease Cas9 [Streptococcus mutans] SEQ ID NO: 230

WP_002277050.1  type II CRISPR RNA-guided endonuclease Cas9 [Streptococcus mutans] SEQ ID NO: 231

WP_002277364.1  type II CRISPR RNA-guided endonuclease Cas9 [Streptococcus mutans] SEQ ID NO: 232

WP_002279025.1  type II CRISPR RNA-guided endonuclease Cas9 [Streptococcus mutans] SEQ ID NO: 233

WP_002279859.1  type II CRISPR RNA-guided endonuclease Cas9 [Streptococcus mutans] SEQ ID NO: 234

WP_002280230.1  type II CRISPR RNA-guided endonuclease Cas9 [Streptococcus mutans] SEQ ID NO: 235

WP_002281696.1  type II CRISPR RNA-guided endonuclease Cas9 [Streptococcus mutans] SEQ ID NO: 236

WP_002282247.1  type II CRISPR RNA-guided endonuclease Cas9 [Streptococcus mutans] SEQ ID NO: 237

WP_002282906.1  type II CRISPR RNA-guided endonuclease Cas9 [Streptococcus mutans] SEQ ID NO: 238

WP_002283846.1  type II CRISPR RNA-guided endonuclease Cas9 [Streptococcus mutans] SEQ ID NO: 239

WP_002287255.1  type II CRISPR RNA-guided endonuclease Cas9 [Streptococcus mutans] SEQ ID NO: 240

WP_002288990.1  type II CRISPR RNA-guided endonuclease Cas9 [Streptococcus mutans] SEQ ID NO: 241

WP_002289641.1  type II CRISPR RNA-guided endonuclease Cas9 [Streptococcus mutans] SEQ ID NO: 242

WP_002290427.1  type II CRISPR RNA-guided endonuclease Cas9 [Streptococcus mutans] SEQ ID NO: 243

WP_002295753.1  type II CRISPR RNA-guided endonuclease Cas9 [Streptococcus mutans] SEQ ID NO: 244

WP_002296423.1  type II CRISPR RNA-guided endonuclease Cas9 [Streptococcus mutans] SEQ ID NO: 245

WP_002304487.1  type II CRISPR RNA-guided endonuclease Cas9 [Streptococcus mutans] SEQ ID NO: 246

WP_002305844.1  type II CRISPR RNA-guided endonuclease Cas9 [Streptococcus mutans] SEQ ID NO: 247

WP_002307203.1  type II CRISPR RNA-guided endonuclease Cas9 [Streptococcus mutans] SEQ ID NO: 248
```

-continued

WP_002310390.1 type II CRISPR RNA-guided endonuclease Cas9 [*Streptococcus mutans*] SEQ ID NO: 249

WP_002352408.1 type II CRISPR RNA-guided endonuclease Cas9 [*Streptococcus mutans*] SEQ ID NO: 250

WP_012997688.1 type II CRISPR RNA-guided endonuclease Cas9 [*Streptococcus mutans*] SEQ ID NO: 251

WP_014677909.1 type II CRISPR RNA-guided endonuclease Cas9 [*Streptococcus mutans*] SEQ ID NO: 252

WP_019312892.1 type II CRISPR RNA-guided endonuclease Cas9 [*Streptococcus mutans*] SEQ ID NO: 253

WP_019313659.1 type II CRISPR RNA-guided endonuclease Cas9 [*Streptococcus mutans*] SEQ ID NO: 254

WP_019314093.1 type II CRISPR RNA-guided endonuclease Cas9 [*Streptococcus mutans*] SEQ ID NO: 255

WP_019315370.1 type II CRISPR RNA-guided endonuclease Cas9 [*Streptococcus mutans*] SEQ ID NO: 256

WP_019803776.1 type II CRISPR RNA-guided endonuclease Cas9 [*Streptococcus mutans*] SEQ ID NO: 257

WP_019805234.1 type II CRISPR RNA-guided endonuclease Cas9 [*Streptococcus mutans*] SEQ ID NO: 258

WP_024783594.1 type II CRISPR RNA-guided endonuclease Cas9 [*Streptococcus mutans*] SEQ ID NO: 259

WP_024784288.1 type II CRISPR RNA-guided endonuclease Cas9 [*Streptococcus mutans*] SEQ ID NO: 260

WP_024784666.1 type II CRISPR RNA-guided endonuclease Cas9 [*Streptococcus mutans*] SEQ ID NO: 261

WP_024784894.1 type II CRISPR RNA-guided endonuclease Cas9 [*Streptococcus mutans*] SEQ ID NO: 262

WP_024786433.1 type II CRISPR RNA-guided endonuclease Cas9 [*Streptococcus mutans*] SEQ ID NO: 263

WP_049473442.1 CRISPR-associated protein Csn1 [*Streptococcus mutans*] SEQ ID NO: 264

WP_049474547.1 CRISPR-associated protein Csn1 [*Streptococcus mutans*] SEQ ID NO: 265

EMC03581.1     hypothetical protein SMU69_09359 [*Streptococcus mutans NLML4*] SEQ ID NO: 266

WP_000428612.1 type II CRISPR RNA-guided endonuclease Cas9 [*Streptococcus oralis*] SEQ ID NO: 267

WP_000428613.1 type II CRISPR RNA-guided endonuclease Cas9 [*Streptococcus oralis*] SEQ ID NO: 268

WP_049523028.1 CRISPR-associated protein Csn1 [*Streptococcus parasanguinis*] SEQ ID NO: 269

WP_003107102.1 type II CRISPR RNA-guided endonuclease Cas9 [*Streptococcus parauberis*] SEQ ID NO: 270

WP_054279288.1 type II CRISPR RNA-guided endonuclease Cas9 [*Streptococcus phocae*] SEQ ID NO: 271

WP_049531101.1 CRISPR-associated protein Csn1 [*Streptococcus pseudopneumoniae*] SEQ ID NO: 272

WP_049538452.1 CRISPR-associated protein Csn1 [*Streptococcus pseudopneumoniae*] SEQ ID NO: 273

WP_049549711.1 CRISPR-associated protein Csn1 [*Streptococcus pseudopneumoniae*] SEQ ID NO: 274

WP_007896501.1 type II CRISPR RNA-guided endonuclease Cas9 [*Streptococcus pseudoporcinus*]
               SEQ ID NO: 275

EFR44625.1     CRISPR-associated protein, Csn1 family [*Streptococcus pseudoporcinus SPIN 20026*]
               SEQ ID NO: 276

WP_002897477.1 type II CRISPR RNA-guided endonuclease Cas9 [*Streptococcus sanguinis*] SEQ ID NO: 277

WP_002906454.1 type II CRISPR RNA-guided endonuclease Cas9 [*Streptococcus sanguinis*] SEQ ID NO: 278

WP_009729476.1 type II CRISPR RNA-guided endonuclease Cas9 [*Streptococcus sp. F0441*] SEQ ID NO: 279

CQR24647.1     CRISPR-associated protein [*Streptococcus sp. FF10*] SEQ ID NO: 280

WP_000066813.1 type II CRISPR RNA-guided endonuclease Cas9 [*Streptococcus sp. M334*] SEQ ID NO: 281

WP_009754323.1 type II CRISPR RNA-guided endonuclease Cas9 [*Streptococcus sp. taxon 056*]
               SEQ ID NO: 282

WP_044674937.1 type II CRISPR RNA-guided endonuclease Cas9 [*Streptococcus suis*] SEQ ID NO: 283

WP_044676715.1 type II CRISPR RNA-guided endonuclease Cas9 [*Streptococcus suis*] SEQ ID NO: 284

WP_044680361.1 type II CRISPR RNA-guided endonuclease Cas9 [*Streptococcus suis*] SEQ ID NO: 285

WP_044681799.1 type II CRISPR RNA-guided endonuclease Cas9 [*Streptococcus suis*] SEQ ID NO: 286

WP_049533112.1 CRISPR-associated protein Csn1 [*Streptococcus suis*] SEQ ID NO: 287

-continued

WP_029090905.1 type II CRISPR RNA-guided endonuclease Cas9 [*Brochothrix thermosphacta*]
        SEQ ID NO: 288

WP_006506696.1 type II CRISPR RNA-guided endonuclease Cas9 [*Catenibacterium mitsuokai*]
        SEQ ID NO: 289

AIT42264.1       Cas9hc: NLS: HA [Cloning vector pYB196] SEQ ID NO: 290
WP_034440723.1 type II CRISPR endonuclease Cas9 [*Clostridiales bacterium* S5-A11] SEQ ID NO: 291

AKQ21048.1       Cas9 [CRISPR-mediated gene targeting vector p (bhsp68-Cas9) ] SEQ ID NO: 292

WP_004636532.1 type II CRISPR RNA-guided endonuclease Cas9 [*Dolosigranulum pigrum*] SEQ ID NO: 293

WP_002364836.1 MULTISPECIES: type II CRISPR RNA-guided endonuclease Cas9 [*Enterococcus*]
        SEQ ID NO: 294

WP_016631044.1 MULTISPECIES: type II CRISPR RNA-guided endonuclease Cas9 [*Enterococcus*]
        SEQ ID NO: 295

EMS75795.1       hypothetical protein H318_06676 [*Enterococcus durans* IPLA 655] SEQ ID NO: 296

WP_002373311.1 type II CRISPR RNA-guided endonuclease Cas9 [*Enterococcus faecalis*] SEQ ID NO: 297

WP_002378009.1 type II CRISPR RNA-guided endonuclease Cas9 [*Enterococcus faecalis*] SEQ ID NO: 298

WP_002407324.1 type II CRISPR RNA-guided endonuclease Cas9 [*Enterococcus faecalis*] SEQ ID NO: 299

WP_002413717.1 type II CRISPR RNA-guided endonuclease Cas9 [*Enterococcus faecalis*] SEQ ID NO: 300

WP_010775580.1 type II CRISPR RNA-guided endonuclease Cas9 [*Enterococcus faecalis*] SEQ ID NO: 301

WP_010818269.1 type II CRISPR RNA-guided endonuclease Cas9 [*Enterococcus faecalis*] SEQ ID NO: 302

WP_010824395.1 type II CRISPR RNA-guided endonuclease Cas9 [*Enterococcus faecalis*] SEQ ID NO: 303

WP_016622645.1 type II CRISPR RNA-guided endonuclease Cas9 [*Enterococcus faecalis*] SEQ ID NO: 304

WP_033624816.1 type II CRISPR RNA-guided endonuclease Cas9 [*Enterococcus faecalis*] SEQ ID NO: 305

WP_033625576.1 type II CRISPR RNA-guided endonuclease Cas9 [*Enterococcus faecalis*] SEQ ID NO: 306

WP_033789179.1 type II CRISPR RNA-guided endonuclease Cas9 [*Enterococcus faecalis*] SEQ ID NO: 307

WP_002310644.1 type II CRISPR RNA-guided endonuclease Cas9 [*Enterococcus faecium*] SEQ ID NO: 308

WP_002312694.1 type II CRISPR RNA-guided endonuclease Cas9 [*Enterococcus faecium*] SEQ ID NO: 309

WP_002314015.1 type II CRISPR RNA-guided endonuclease Cas9 [*Enterococcus faecium*] SEQ ID NO: 310

WP_002320716.1 type II CRISPR RNA-guided endonuclease Cas9 [*Enterococcus faecium*] SEQ ID NO: 311

WP_002330729.1 type II CRISPR RNA-guided endonuclease Cas9 [*Enterococcus faecium*] SEQ ID NO: 312

WP_002335161.1 type II CRISPR RNA-guided endonuclease Cas9 [*Enterococcus faecium*] SEQ ID NO: 313

WP_002345439.1 type II CRISPR RNA-guided endonuclease Cas9 [*Enterococcus faecium*] SEQ ID NO: 314

WP_034867970.1 type II CRISPR RNA-guided endonuclease Cas9 [*Enterococcus faecium*] SEQ ID NO: 315

WP_047937432.1 type II CRISPR RNA-guided endonuclease Cas9 [*Enterococcus faecium*] SEQ ID NO: 316

WP_010720994.1 type II CRISPR RNA-guided endonuclease Cas9 [*Enterococcus hirae*] SEQ ID NO: 317

WP_010737004.1 type II CRISPR RNA-guided endonuclease Cas9 [*Enterococcus hirae*] SEQ ID NO: 318

WP_034700478.1 type II CRISPR RNA-guided endonuclease Cas9 [*Enterococcus hirae*] SEQ ID NO: 319

WP_007209003.1 type II CRISPR RNA-guided endonuclease Cas9 [*Enterococcus italicus*] SEQ ID NO: 320

WP_023519017.1 type II CRISPR RNA-guided endonuclease Cas9 [*Enterococcus mundtii*] SEQ ID NO: 321

WP_010770040.1 type II CRISPR RNA-guided endonuclease Cas9 [*Enterococcus phoeniculicola*] SEQ ID NO: 322

WP_048604708.1 type II CRISPR RNA-guided endonuclease Cas9 [*Enterococcus* sp. AM1] SEQ ID NO: 323

WP_010750235.1 type II CRISPR RNA-guided endonuclease Cas9 [*Enterococcus villorum*] SEQ ID NO: 324

AII16583.1       Cas9 endonuclease [Expression vector pCas9] SEQ ID NO: 325

WP_029073316.1 type II CRISPR RNA-guided endonuclease Cas9 [*Kandleria vitulina*] SEQ ID NO: 326

-continued

| Accession | Description | SEQ ID NO |
|---|---|---|
| WP_031589969.1 | type II CRISPR RNA-guided endonuclease Cas9 [*Kandleria vitulina*] | 327 |
| KDA45870.1 | CRISPR-associated protein Cas9/Csn1, subtype II/NMEMI [*Lactobacillus animalis*] | 328 |
| WP_039099354.1 | type II CRISPR RNA-guided endonuclease Cas9 [*Lactobacillus curvatus*] | 329 |
| AKP02966.1 | hypothetical protein ABB45_04605 [*Lactobacillus farciminis*] | 330 |
| WP_010991369.1 | type II CRISPR RNA-guided endonuclease Cas9 [*Listeria innocua*] | 331 |
| WP_033838504.1 | type II CRISPR RNA-guided endonuclease Cas9 [*Listeria innocua*] | 332 |
| EHN60060.1 | CRISPR-associated protein, Csn1 family [*Listeria innocua* ATCC 33091] | 333 |
| EFR89594.1 | crispr-associated protein, Csn1 family [*Listeria innocua* FSL S4-378] | 334 |
| WP_038409211.1 | type II CRISPR RNA-guided endonuclease Cas9 [*Listeria ivanovii*] | 335 |
| EFR95520.1 | crispr-associated protein Csn1 [*Listeria ivanovii* FSL F6-596] | 336 |
| WP_003723650.1 | type II CRISPR RNA-guided endonuclease Cas9 [*Listeria monocytogenes*] | 337 |
| WP_003727705.1 | type II CRISPR RNA-guided endonuclease Cas9 [*Listeria monocytogenes*] | 338 |
| WP_003730785.1 | type II CRISPR RNA-guided endonuclease Cas9 [*Listeria monocytogenes*] | 339 |
| WP_003733029.1 | type II CRISPR RNA-guided endonuclease Cas9 [*Listeria monocytogenes*] | 340 |
| WP_003739838.1 | type II CRISPR RNA-guided endonuclease Cas9 [*Listeria monocytogenes*] | 341 |
| WP_014601172.1 | type II CRISPR RNA-guided endonuclease Cas9 [*Listeria monocytogenes*] | 342 |
| WP_023548323.1 | type II CRISPR RNA-guided endonuclease Cas9 [*Listeria monocytogenes*] | 343 |
| WP_031665337.1 | type II CRISPR RNA-guided endonuclease Cas9 [*Listeria monocytogenes*] | 344 |
| WP_031669209.1 | type II CRISPR RNA-guided endonuclease Cas9 [*Listeria monocytogenes*] | 345 |
| WP_033920898.1 | type II CRISPR RNA-guided endonuclease Cas9 [*Listeria monocytogenes*] | 346 |
| AKI42028.1 | CRISPR-associated protein [*Listeria monocytogenes*] | 347 |
| AKI50529.1 | CRISPR-associated protein [*Listeria monocytogenes*] | 348 |
| EFR83390.1 | crispr-associated protein Csn1 [*Listeria monocytogenes* FSL F2-208] | 349 |
| WP_046323366.1 | type II CRISPR RNA-guided endonuclease Cas9 [*Listeria seeligeri*] | 350 |
| AKE81011.1 | Cas9 [Plant multiplex genome editing vector pYLCRISPR/Cas9Pubi-H] | 351 |
| CUO82355.1 | Uncharacterized protein conserved in bacteria [*Roseburia hominis*] | 352 |
| WP_033162887.1 | type II CRISPR RNA-guided endonuclease Cas9 [*Sharpea azabuensis*] | 353 |
| AGZ01981.1 | Cas9 endonuclease [synthetic construct] | 354 |
| AKA60242.1 | nuclease deficient Cas9 [synthetic construct] | 355 |
| AKS40380.1 | Cas9 [Synthetic plasmid pFC330] | 356 |
| 4UN5_B | Cas9, Chain B, Crystal Structure | 357 |

```
WP_010922251   1  MDKK-YSIGLDIGTNSVGWAVITDEYKVPSKKFKVLGNTDRHSIKKNLIGALLFDSGETA--EATRLKRTARRRYT   73
WP_039695303   1  MTKKnYSIGLDIGTNSVGWAVITDDYKVPAKKMKVLGNTDKKYIKKNLLGALLFDSGETA--EATRLKRTARRRYT   74
WP_045635197   1  K-KG-YSIGLDIGTNSVGFAVITDDYKVPSKKMKVLGNTDKRFIKKNLIGALLFDEGTTA--EARRLKRTARRRYT   73
5AXW_A         1  MKRN-YILGLDIGITSVGYGII--DYET-----------RDVIDA---GVRLFKEANVEnnEGRRSKRGARRLKR   61
WP_009880683      ---------------------------------------------------------------------------

WP_010922251   1  MDKK-YSIGLDIGTNSVGWAVITDEYKVPSKKFKVLGNTDRHSIKKNLIGALLFDSGETA--EATRLKRTARRRYT   73
WP_011054416   1  MDKK-YSIGLDIGTNSVGWAVITDDYKVPSKKLKGLGNTDRHGIKKNLIGALLFDSGETA--EATRLKRTARRRYT   73
WP_011284745   1  MDKK-YSIGLDIGTNSVGWAVITDDYKVPSKKFKVLGNTDRHSIKKNLIGALLFDSGETA--EATRLKRTARRRYT   73
WP_011285506   1  MDKK-YSIGLDIGTNSVGWAVITDDYKVPSKKFKVLGNTDRHSIKKNLIGALLFDSGETA--EATRLKRTARRRYT   73
```

```
WP_011527619    1  MDKK-YSIGLDIGTNSVGWAVITDDYKVPSKKFKVLGNTDRHSIKKNLIGALLFDSGEIA--EATRLKRTARRRYT   73
WP_012560673    1  MDKK-YSIGLDIGTNSVGWAVITDDYKVPSKKFKVLGNTDRHSIKKNLIGALLFDSGETA--EATRLKRTARRRYT   73
WP_014407541    1  MDKK-YSIGLDIGTNSVGWAVITDDYKVPSKKFKVLGNTDRHSIKKNLIGALLFGSGETA--EATRLKRTARRRYT   73
WP_020905136    1  MDKK-YSIGLDIGTNSVGWAVITDDYKVPSKKFKVLGNTDRHSIKKNLIGALLFDSGETA--EATRLKRTARRRYT   73
WP_023080005    1  MDKK-YSIGLDIGTNSVGWAVITDDYKVPSKKLKVLGNTDRHGIKKNLIGALLFDSGETA--EATRLKRTARRRYT   73
WP_023610282    1  MDKK-YSIGLDIGTNSVGWAVITDDYKVPSKKLKVLGNTDRHGIKKNLIGALLFDSGETA--EATRLKRTARRRYT   73
WP_030125963    1  MDKK-YSIGLDIGTNSVGWAVITDDYKVPSKKFKVLGNTDRHSIKKNLIGALLFDSGETA--EATRLKRTARRRYT   73
WP_030126706    1  MDKK-YSIGLDIGTNSVGWAVITDDYKVPSKKFKVLGNTDRHGIKKNLIGALLFDSGETA--EATRLKRTARRRYT   73
WP_031488318    1  MDKK-YSIGLDIGTNSVGWAVITDDYKVPSKKFKVLGNTDRHSIKKNLIGALLFDSGETA--EATRLKRTARRRYT   73
WP_032460140    1  MDKK-YSIGLDIGTNSVGWAVITDDYKVPSKKFKVLGNTDRHSIKKNLIGALLFDSGETA--EATRLKRTARRRYT   73
WP_032461047    1  MDKK-YSIGLDIGTNSVGWAVITDDYKVPSKKFKVLGNTDRHSIKKNLIGALLFDSGETA--EATRLKRTARRRYT   73
WP_032462016    1  MDKK-YSIGLDIGTNSVGWAVITDDYKVPSKKFKVLGNTDRHSIKKNLIGALLFDSGETA--EATRLKRTARRRYT   73
WP_032462936    1  MDKK-YSIGLDIGTNSVGWAVITDDYKVPSKKFKVLGNTDRHSIKKNLIGALLFDSGETA--EATRLKRTARRRYT   73
WP_032464890    1  MDKK-YSIGLDIGTNSVGWAVITDDYKVPSKKFKVLGNTDRHSIKKNLIGALLFDSGEIA--EATRLKRTARRRYT   73
WP_033888930       ---------------------------------------------------------------------------
WP_038431314    1  MDKK-YSIGLDIGTNSVGWAVITDDYKVPSKKFKVLGNTDRHSIKKNLIGALLFDSGETA--EATRLKRTARRRYT   73
WP_038432938    1  MDKK-YSIGLDIGTNSVGWAVITDDYKVPSKKFKVLGNTDRHSIKKNLIGALLFDSGETA--EATRLKRTARRRYT   73
WP_038434062    1  MDKK-YSIGLDIGTNSVGWAVITDDYKVPSKKFKVLGNTDRHSIKKNLIGALLFDSGETA--EATRLKRTARRRYT   73
BAQ51233           ---------------------------------------------------------------------------
KGE60162           ---------------------------------------------------------------------------
KGE60856           ---------------------------------------------------------------------------
WP_002989955    1  MDKK-YSIGLDIGTNSVGWAVITDDYKVPSKKFKVLGNTDRHSIKKNLIGALLFDSGEIA--EATRLKRTARRRYT   73
WP_003030002    1  MDQK-YSIGLDIGTNSVGWAVVTDDYKVPAKKMKVLGNTDKQSIKKNLLGALLFDSGETA--EATRLKRTARRRYT   73
WP_003065552    1  MTKKNYSIGLDIGTNSVGWAVITDDYKVPAKKMKVLGNTDKKYIKKNLLGALLFDSGETA--EATRLKRTARRRYT   74
WP_001040076    1  MNKP-YSIGLDIGTNSVGWSIITDDYKVPAKKIRVLGNTDKEYIKKNLIGALLFDGGNTA--ADRRLKRTARRRYT   73
WP_001040078    1  MNKP-YSIGLDIGTNSVGWSIITDDYKVPAKKMRVLGNTDKEYIKKNLIGALLFDGGNTA--ADRRLKRTARRRYT   73
WP_001040080    1  MNKP-YSIGLDIGTNSVGWSIITDDYKVPAKKMRVLGNTDKEYIKKNLIGALLFDGGNTA--ADRRLKRTARRRYT   73
WP_001040081    1  MNKP-YSIGLDIGTNSVGWSIITDDYKVPAKKMRVLGNTDKEYIKKNLIGALLEDGGNTA--ADRRLKRTARRRYT   73
WP_001040083    1  MNKP-YSIGLDIGTNSVGWSIITDDYKVPAKKMRVLGNTDKEYIKKNLIGALLFDGGNTA--ADRRLKRTARRRYT   73
WP_001040085    1  MNKP-YSIGLDIGTNSVGWSIITDDYKVPAKKMRVLGNTDKEYIKKNLIGALLFDGGNTA--ADRRLKRTARRRYT   73
WP_001040087    1  MNKP-YSIGLDIGTNSVGWSIITDDYKVPAKKMRVLGNTDKEYIKKNLIGALLFDGGNTA--ADRRLKRTARRRYT   73
WP_001040088    1  MNKP-YSIGLDIGTNSVGWSIITDDYKVPAKKMRVLGNTDKEYIKKNLIGALLFDGGNTA--ADRRLKRTARRRYT   73
WP_001040089    1  MNKP-YSIGLDIGTNSVGWSIITDDYKVPAKKMRVLGNTDKEYIKKNLIGALLFDGGNTA--ADRRLKRTARRRYT   73
WP_001040090    1  MNKP-YSIGLDIGTNSVGWSIITDDYKVPAKKMRVLGNTDKEYIKKNLIGALLFDGGNTA--ADRRLKRTARRRYT   73
WP_001040091    1  MNKP-YSIGLDIGTNSVGWSIITDDYKVPAKKMRVLGNTDKEYIKKNLIGALLFDGGNTA--ADRRLKRTARRRYT   73
WP_001040092    1  MNKP-YSIGLDIGTNSVGWSIITDDYKVPAKKMRVLGNTDKEYIKKNLIGALLFDGGNTA--ADRRLKRTARRRYT   73
WP_001040094    1  MNKP-YSIGLDIGTNSVGWSIITDDYKVPAKKMRVLGNTDKEYIKKNLIGALLFDGGNTA--ADRRLKRTARRRYT   73
WP_001040095    1  MNKP-YSIGLDIGTNSVGWSIITDDYKVPAKKMRVLGNTDKEYIKKNLIGALLFDGGNTA--ADRRLKRTARRRYT   73
WP_001040096    1  MNKP-YSIGLDIGTNSVGWSIITDDYKVPAKKMRVLGNTDKEYIKKNLIGALLFDGGNTA--ADRRLKRTARRRYT   73
WP_001040097    1  MNKP-YSIGLDIGTNSVGWSIITDDYKVPAKKMRVLGNTDKEYIKKNLIGALLFDGGNTA--ADRRLKRTARRRYT   73
```

-continued

| | | |
|---|---|---|
| WP_001040098 | 1 | MNKP-YSIGLDIGTNSVGWSIITDDYKVPAKKMRVLGNTDKEYIKKNLIGALLFDGGNTA--ADRRLKRTARRRYT 73 |
| WP_001040099 | 1 | MNKP-YSIGLDIGTNSVGWSIITDDYKVPAKKMRVLGNTDKEYIKKNLIGALLFDGGNTA--ADRRLKRTARRRYT 73 |
| WP_001040100 | 1 | MNKP-YSIGLDIGTNSVGWSIITDDYKVPAKKMRVLGNTDKEYIKKNLIGALLFDGGNTA--ADRRLKRTARRRYT 73 |
| WP_001040104 | 1 | MNKP-YSIGLDIGTNSVGWSIITDDYKVPAKKMRVLGNTDKEYIKKNLIGALLFDGGNTA--ADRRLKRTARRRYT 73 |
| WP_001040105 | 1 | MNKP-YSIGLDIGTNSVGWSIITDDYKVPAKKMRVLGNTDKEYIKKNLIGALLFDGGNTA--ADRRLKRTSRRRYT 73 |
| WP_001040106 | 1 | MNKP-YSIGLDIGTNSVGYSVVTDDYKVPAKKMRVLGNTDKEYIKKNLIGALLFDGGNTA--SDRRLKRTARRRYT 73 |
| WP_001040107 | 1 | MNKP-YSIGLDIGTNSVGYSVVTDDYKVPAKKMRVLGNTDKEYIKKNLIGALLFDGGNTA--SDRRLKRTARRRYT 73 |
| WP_001040108 | 1 | MNKP-YSIGLDIGTNSVGYSVVTDDYKVPAKKMRVLGNTDKEYIKKNLIGALLEDGGNTA--SDRRLKRTARRRYT 73 |
| WP_001040109 | 1 | MNKP-YSIGLDIGTNSVGYSVVTDDYKVPAKKMRVLGNTDKEYIKKNLIGALLFDGGNTA--SDRRLKRTARRRYT 73 |
| WP_001040110 | 1 | MNKP-YSIGLDIGTNSVGYSVVTDDYKVPAKKMRVLGNTDKEYIKKNLIGALLFDGGNTA--SDRRLKRTARRRYT 73 |
| WP_015058523 | 1 | MNKP-YSIGLDIGTNSVGWSIITDDYKVPAKKMRVLGNTDKEYIKKNLIGALLFDGGNTA--ADRRLKRTARRRYT 73 |
| WP_017643650 | 1 | MNKP-YSIGLDIGTNSVGWSIITDDYKVPAKKMRVLGNTDKEYIKKNLIGALLFDGGNTA--ADRRLKRTARRRYT 73 |
| WP_017647151 | 1 | MNKP-YSIGLDIGTNSVGWSIITDDYKVPAKKMRVLGNTDKEYIKKNLIGALLFDGGNTA--SDRRLKRTARRRYT 73 |
| WP_017648376 | 1 | MNKP-YSIGLDIGTNSVGWSIITDDYKVPAKKMRVLGNTDKEYIKKNLIGALLFDGGNTA--SDRRLKRTARRRYT 73 |
| WP_017649527 | 1 | MNKP-YSIGLDIGTNSVGWSIITDDYKVPAKKMRVLGNTDKEYIKKNLIGALLFDGGNTA--ADRRLKRTARRRYT 73 |
| WP_017771611 | 1 | MNKP-YSIGLDIGTNSVGYSVVTDDYKVPAKKMRVLGNTDKEYIKKNLIGALLFDGGNTA--SDRRLKRTARRRYT 73 |
| WP_017771984 | 1 | MNKP-YSIGLDIGTNSVGWSIITDDYKVPAKKMRVLGNTDKEYIKKNLIGALLFDGGNTA--ADRRLKRTARRRYT 73 |
| CFQ25032 | 1 | MNKP-YSIGLDIGTNSVGWSIITDDYKVPAKKMRVLGNTDKEYIKKNLIGALLFDGGNTA--ADRRLKRTARRRYT 73 |
| CFV16040 | 1 | MNKP-YSIGLDIGTNSVGWSIITDDYKVPAKKMRVLGNTDKEYIKKNLIGALLFDGGNTA--ADRRLKRTARRRYT 73 |
| KLJ37842 | 1 | MNKP-YSIGLDIGTNSVGWSIITDDYKVPAKKMRVLGNTDKEYIKKNLIGALLFDGGNTA--ADRRLKRTARRRYT 73 |
| KLJ72361 | 1 | MNKP-YSIGLDIGTNSVGWSIITDDYKVPAKKMRVLGNTDKEYIKKNLIGALLFDGGNTA--ADRRLKRTARRRYT 73 |
| KLL20707 | 1 | MNKP-YSIGLDIGTNSVGWSIITDDYKVPAKKMRVLGNTDKEYIKKNLIGALLFDGGNTA--ADRRLKRTARRRYT 73 |
| KLL42645 | 1 | MNKP-YSIGLDIGTNSVGYSVVTDDYKVPAKKMRVLGNTDKEYIKKNLIGALLFDGGNTA--SDRRLKRTARRRYT 73 |
| WP_047207273 | 1 | MNKP-YSIGLDIGTNSVGWSIITDDYKVPAKKMRVLGNTDKEYIKKNLIGALLFDGRNTA--ADRRLKRTARRRYT 73 |
| WP_047209694 | 1 | MNKP-YSIGLDIGTNSVGWSIITDDYKVPAKKMRVLGNTDKEYIKKNLIGALLFDGGNTA--ADRRLKRTARRRYT 73 |
| WP_050198062 | 1 | MNKP-YSIGLDIGTNSVGWSIITDDYKVPAKKMRVLGNTDKEYIKKNLIGALLFDGGNTA--ADRRLKRTARRRYT 73 |
| WP_050201642 | 1 | MNKP-YSIGLDIGTNSVGWSIITDDYKVPAKKMRVLGNTDKEYIKKNLIGALLEDGGNTA--ADRRLKRTARRRYT 73 |
| WP_050204027 | 1 | MNKP-YSIGLDIGTNSVGYSVVTDDYKVPAKKMRVLGNTDKEYIKKNLIGALLFDGGNTA--SDRRLKRTARRRYT 73 |
| WP_050881965 | 1 | MNKP-YSIGLDIGTNSVGWSIITDDYKVPAKKMRVLGNTDKEYIKKNLIGALLFDGGNTA--ADRRLKRTARRRYT 73 |
| WP_050886065 | 1 | MNKP-YSIGLDIGTNSVGWSIITDDYKVPAKKMRVLGNTDKEYIKKNLIGALLFDGGNTA--ADRRLKRTARRRYT 73 |
| AHN30376 | 1 | MNKP-YSIGLDIGTNSVGWSIITDDYKVPAKKMRVLGNTDKEYIKKNLIGALLFDGGNTA--ADRRLKRTARRRYT 73 |
| EAO78426 | 1 | MNKP-YSIGXDIGTNSVGWSIITDDYKVPAKKMRVLGNTDKEYIKKNLIGALLFDGGNTA--ADRRLKRTARRRYT 73 |
| CCW42055 | 1 | MNKP-YSIGLDIGTNSVGWSIITDDYKVPAKKMRVLGNTDKEYIKKNLIGALLFDGGNTA--ADRRLKRIARRRYT 73 |
| WP_003041502 | 1 | MNQK-YSIGLDIGTNSVGWAVITDDYKVPAKKMKVLGNTDKQSIKKNLLGALLFDSGETA--EATRLKRTARRRYT 73 |
| WP_037593752 | 1 | MKKE-YSIGLDIGTNSVGWAVITDDYKVPAKKMKVLGNTDKQSIKKNLLGALLFDSGETA--EATRLKRTARRRYT 74 |
| WP_049516684 | 1 | MKKE-YSIGLDIGTNSVGWAVITDDYKVPAKKMKVLGNTDKQSIKKNLLGALLFDSGETA--EATRLKRTARRRYT 74 |
| GAD46167 | 1 | MKKE-YSIGLDIGTNSVGWAVITDDYKVPAKKMKVLGNTDKQSIKKNLLGALLFDSGETA--EATRLKRTARRRYT 73 |
| WP_018363470 | 1 | MTKKnYSIGLDIGTNSVGWAVITDDYKVPAKKMKVLGNTDKKYIKKNLLGALLFDSGETA--EATRLKRTARRRYT 74 |
| WP_003043819 | 1 | MEKK-YSIGLDIGTNSVGWAVITDDYKVPSKKFKVLGNTNRKSIKKNLMGALLFDSGETA--EATRLKRTARRRYT 73 |
| WP_006269658 | 1 | MGKP-YSIGLDIGTNSVGWAVVTDDYKVPAKKMKVLGNTDKQSIKKNLLGALLFDSGETA--EATRLKRTARRRYT 73 |
| WP_048800889 | 1 | MTQK-YSIGLDIGTNSVGWAIVTDDYKVPAKKMKILGNTNKQYIKKNLLGALLFDSGETA--KATRLKRTARRRYT 73 |

-continued

| | | | |
|---|---|---|---|
| WP_012767106 | 1 | MDKK-YSIGLDIGTNSVGWAVITDDYKVPSKKFKVLGNTDRHSIKKNLIGALLFDSGETA--EATRLKRTARRRYT | 73 |
| WP_014612333 | 1 | MDKK-YSIGLDIGTNSVGWAVITDDYKVPSKKFKVLGNTDRHSIKKNLIGALLFDSGETA--EATRLKRTARRRYT | 73 |
| WP_015017095 | 1 | MDKK-YSIGLDIGTNSVGWAVITDDYKVPSKKFKVLGNTDRHSIKKNLIGALLFDSGETA--EATRLKRTARRRYT | 73 |
| WP_015057649 | 1 | MDKK-YSIGLDIGTNSVGWAVITDDYKVPSKKFKVLGNTDRHSIKKNLIGALLFDSGETA--EATRLKRTARRRYT | 73 |
| WP_048327215 | 1 | MDKK-YSIGLDIGTNSVGWAVITDDYKVPSKKFKVLGNTDRHSIKKNLIGALLFDSGETA--EATRLKRTARRRYT | 73 |
| WP_049519324 | 1 | MDKK-YSIGLDIGTNSVGWAVITDDYKVPSKKFKVLGNTDRHSIKKNLIGALLFDSGETA--EATRLKRTARRRYT | 73 |
| WP_012515931 | 1 | MKKP-YTIALDIGTNSVGWVVVTDDYRVPTKKMKVLGNTERKTIKKNLIGALLFDSGDTA--EGTRLKRTARRRYT | 73 |
| WP_021320964 | 1 | MKKP-YTIALDIGTNSVGWVVVTDDYRVPTKKMKVLGNTERKTIKKNLIGALLFDSGDTA--EGTRLKRTARRRYT | 73 |
| WP_037581760 | 1 | MKKP-YTIALDIGTNSVGWVVVTDDYRVPTKKMKVLGNTERKTIKKNLIGALLFDSGDTA--EGTRLKRTARPRYT | 73 |
| WP_004232481 | 1 | M-EKtYSIGLDIGTNSVGWAVITDDYKVPAKKMKVLGNTDKKYIKKNLLGALLFDSGETA--EATRLKRAARRRYT | 73 |
| WP_009854540 | 1 | MTKKNYSIGLDIGTNSVGWAVITDDYKVPAKKMKVLGNTDKKYIKKNLLGALLFDSGETA--EATRLKRTARRRYT | 74 |
| WP_012962174 | 1 | MTEKNYSIGLDIGTNSVGWAVITDDYKVPAKKMKVLGNTDKKYIKKNLLGALLFDNGETA--EATRLKRTARRRYT | 74 |
| WP_039695303 | 1 | MTKKNYSIGLDIGTNSVGWAVITDDYKVPAKKMKVLGNTDKKYIKKNLLGALLFDSGETA--EATRLKRTARRRYT | 74 |
| WP_014334983 | 1 | M-EKSYSIGLDIGTNSVGWAVITDDYKVPAKKMKVLGNTDKKYIKKNLLGALLFDSGETA--EVTRLKRTARRRYT | 73 |
| WP_003099269 | 1 | MRKP-YSIGLDIGTNSVGWAVITDDYKVPSKKMRIQGTTDRTSIKKNLIGALLFDNGETA--EATRLKRTTRRRYT | 73 |
| AHY15608 | 1 | MRKP-YSIGLDIGTNSVGWAVITDDYKVPSKKMRIQGTTDRTSIKKNLIGALLFDNGETA--EATRLKRTTRRRYT | 73 |
| AHY17476 | 1 | MRKP-YSIGLDIGTNSVGWAVITDDYKVPSKKMRIQGTTDRTSIKKNLIGALLFDNGETA--EATRLKRTTRRRYT | 73 |
| ESR09100 | | ------------------------------------------------------------------------- | |
| AGM98575 | 1 | MRKP-YSIGLDIGTNSVGWAVITDDYKVPSKKMRIQGTTDRTSIKKNLIGALLFDNGETA--EATRLKRTTRRRYT | 73 |
| ALF27331 | 1 | MKKP-YSIGLDIGTNSVGWAVVTDDYKVPAKKMKVLGNTDKSHIKKNLLGALLFDSGNTA--EDRRLKRTARRRYT | 73 |
| WP_018372492 | 1 | MKKP-YSIGLDIGTNSVGWAVMEDYKVPSKKMKVLGNTDKQSIKKNLIGALLFDSGETAv--ERRLNRTTSRRYD | 73 |
| WP_045618028 | 1 | NNKP-YSIGLDIGTNSVGWAVITDDYKVPSKKMKVLGNTDKHFIKKNLLGALLFDEGTTA--EDRRLKRTARRRYT | 74 |
| WP_045635197 | 1 | K-KG-YSIGLDIGTNSVGFAVITDDYKVPSKKMKVLGNTDKRFIKKNLIGALLFDEGTTA--EARRLKRTARRRYT | 73 |
| WP_002263549 | 1 | MKKP-YSIGLDIGTNSVGWAVVTDDYKVPAKKMKVLGNTDKSHIEKNLLGALLFDSGNTA--EDRRLKRTARRRYT | 73 |
| WP_002263887 | 1 | MKKP-YSIGLDIGTNSVGWAVVTDDYKVPAKKMKVLGNTDKSHIEKNLLGALLFDSGNTA--EDRRLKRTARRRYT | 73 |
| WP_002264920 | 1 | MKKP-YSIGLDIGTNSVGWAVVTDDYKVPAKKMKVLGNTDKSHIKKNLLGALLEDSGNTA--EDRRLKRTARRRYT | 73 |
| WP_002269043 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002269448 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002271977 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002272766 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002273241 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002275430 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002276448 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002277050 | 1 | MKKS-YSIGLDIGTNSVGWAVVTDDYKVPAKKMKVLGNTDKSHIKKNLLGALLFDSGNTA--EDRRLKRTARRRYT | 73 |
| WP_002277364 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002279025 | 1 | MKKP-YSIGLDIGTNSVGWAVVTDDYKVPAKKMKVLGNTDKSHIEKNLLGALLFDSGNTA--EDRRLKRTARRRYT | 73 |
| WP_002279859 | 1 | MKKP-YSIGLDIGTNSVGWAVVTDDYKVPAKKMKVLGNTDKSHIKKNLLGALLFDSGNTA--EDRRLKRTARRRYT | 73 |
| WP_002280230 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002281696 | 1 | MKKP-YSIGLDIGTNSVGWAVVTDDYKVPAKKMKVLGNTDKSHIKKNLLGALLFDSGNTA--ADRRLKRTARRRYT | 73 |
| WP_002282247 | 1 | MKKP-YSIGLDIGTNSVGWAVVTDDYKVPAKKMKVLGNTDKSHIKKNLLGALLFDSGNTA--EDRRLKRTARRRYT | 73 |

-continued

```
WP_002282906    1  MKKP-YSIGLDIGTNSVGWSVVTDDYKVPAKKMKVLGNTDKSHIEKNLLGALLFDSGNTA--EDRRLKRTARRRYT    73
WP_002283846    1  MKKP-YSIGLDIGTNSVGWAVVTDDYKVPAKKMKVLGNTDKSHIKKNLLGALLFDSGNTA--EDRRLKRTARRRYT    73
WP_002287255    1  MKKP-YSIGLDIGTNSVGWAVVTDDYKVSAKKMKVLGNTDKSHIKKNLLGALLFDSGNTA--EDRRLKRTARRRYT    73
WP_002288990    1  MKKP-YSIGLDIGTNSVGWAVVIDDYKVPAKKMKVLGNTDKSHIKKNLLGALLFDSGNTA--EDRRLKRTARRRYT    73
WP_002289641    1  MKKP-YSIGLDIGTNSVGWAVVTDDYKVPAKKMKVLGNTDKSHIKKNLLGALLFDSGNTA--EDRRLKRTTRRRYT    73
WP_002290427    1  MKKP-YSIGLDIGTNSVGWAVVTDDYKVPAKKMKVLGNTDKSHIKKNLLGALLFDSGNTA--EDRRLKRTARRRYT    73
WP_002295753    1  MKKP-YSIGLDIGTNSVGWAVVTDDYKVPAKKMKVLGNTDKSHIKKNLLGALLFDSGNTA--EDRRLKRTARRRYT    73
WP_002296423    1  MKKP-YSIGLDIGTNSVGWAVVTDDYKVPAKKMKVLGNTDKSHIKKNLLGALLFDSGNTA--EDRRLKRTARRRYT    73
WP_002304487    1  MKKP-YSIGLDIGTNSVGWAVVTDDYKVPAKKMKVLGNTDKSHIKKNLLGALLFDSGNTA--EDRRLKRTARRRYT    73
WP_002305844    1  MKKP-YSIGLDIGTNSVGWAVVTDDYKVPAKKMKVLGNTDKSHIKKNLLGALLFDSGNTA--EDRRLKRTARRRYT    73
WP_002307203    1  MKKP-YSIGLDIGTNSVGWAVVTDDYKVPAKKMKVLGNTDKSHIKKNLLGALLFDSGNTA--EDRRLKRTARRRYT    73
WP_002310390    1  MKKP-YSIGLDIGTNSVGWAVVTDDYKVPAKKMKVLGNTDKSHIKKNLLGALLFDSGNTA--EDRRLKRTARRRYT    73
WP_002352408    1  MKKP-YSIGLDIGTNSVGWAVVTDDYKVPAKKMKVLGNTDKSHIKKNLLGALLFDSGNTA--EDRRLKRTARRRYT    73
WP_012997688    1  MKKP-YSIGLDIGTNSVGWAVVTDDYKVPAKKMKVLGNTDKSHIKKNLLGALLFDSGNTA--ADRRLKRTARRRYT    73
WP_014677909    1  MKKP-YSIGLDIGTNSVGWAVVTDDYKVPDKKMKVLGNTDKSHIKKNLLGALLFDSGNTA--EDRRLKRTARRRYT    73
WP_019312892    1  MKKP-YSIGLDIGTNSVGWAVVTDDYKVPAKKMKVLGNTDKSHIKKNLLGALLFDSGNTA--ADRRLKRTARRRYT    73
WP_019313659    1  MKKP-YSIGLDIGTNSVGWAVVTDDYKVPAKKMKVLGNTDKSHIEKNLLGALLFDSGNTA--EDRRLKRTARRRYT    73
WP_019314093    1  MKKP-YSIGLDIGTNSVGWAVVTDDYKVPAKKMKVLGNTDKSHIKKNLLGALLFDSGNTA--EDRRLKRTARRRYT    73
WP_019315370    1  MKKP-YSIGLDIGTNSVGWAVVTDDYKVPAKKMKVLGNTDKSHIKKNLLGALLFDSGNTA--EDRRLKRTARRRYT    73
WP_019803776    1  MKKP-YSIGLDIGTNSVGWAVVTDDYKVPAKKMKVLGNTDKSHIEKNLLGALLFDSGNTA--EDRRLKRTARRRYT    73
WP_019805234    1  MKKP-YSIGLDIGTNSVGWAVVTDDYKVPAKKMKVLGNTDKSHIKKNLLGALLFDSGNTA--EDRRLKRTARRRYT    73
WP_024783594    1  MKKP-YSIGLDIGTNSVGWAVVTDDYKVPAKKMKVLGNTDKSHIEKNLLGALLFDSGNTA--EDRRLKRTARRRYT    73
WP_024784288    1  MKKP-YSIGLDIGTNSVGWAVVTDDYKVPAKKMKVLGNTDKSHIKKNLLGALLFDSGNTA--EDRRLKRTARRRYT    73
WP_024784666    1  MKKP-YSIGLDIGTNSVGWAVVTDDYKVPAKKMKVLGNTDKSHIKKNLLGALLFDSGNTA--ADRRLKRTARRRYT    73
WP_024784894    1  MKKP-YSIGLDIGTNSVGWAVVTDDYKVPAKKMKVLGNTDKSHIKKNLLGALLFDSGNTA--EDRRLKRTTRRRYT    73
WP_024786433    1  MKKP-YSIGLDIGTNSVGWAVVTDDYKVPAKKMKVLGNTDKSHIKKNLLGALLFDSGNTA--ADRRLKRTARRRYT    73
WP_049473442    1  MKKP-YSIGLDIGTNSVGWAVVTDDYKVPAKKMKVLGNTDKSHIKKNLLGALLFDSGNTA--ADRRLKRTARRRYT    73
WP_049474547    1  MKKP-YSIGLDIGTNSVGWAVVTDDYKVPAKKMKVLGNTDKSHIKKNLLGALLFDSGNTA--EDRRLKRTTRRRYT    73
EMC03581        1  MDL--------IGTNSVGWAVVTDDYKVPAKKMKVLGNTDKSHIKKNLLGALLFDSGNTA--ADRRLKRTARRRYT    66
WP_000428612    1  ENKN-YSIGLDIGTNSVGWAVITDDYKVPSKKMKVLGNTDKRFIKKNLIGALLEDEGTTA--EARRLKRTARRRYT    74
WP_000428613    1  ENKN-YSIGLDIGTNSVGWSVITDDYKVPSKKMKVLGNTDKRFIKKNLIGALLFDEGTTA--EARRLKRTARRRYT    74
WP_049523028    1  K-KP-YSIGLDIGTNSVGWAVITDDYKVPAKKMKVLGNTNKESIKKNLIGALLFDAGNTA--ADRRLKRTARRRYT    73
WP_003107102    1  -----------------------------MKVLGNTDRQTVKKNMIGTLLFDSGETA--EARRLKRTARRRYT    42
WP_054279288    1  -KKS-YSIGLDIGTNSVGWAVITDDYKVPAKKMKVLGNTSRQSIKKNMIGALLFDEGGPA--ASTRVKRTTRRRYT    75
WP_049531101    1  SNKP-YSIGLDIGTNSVGWAVITDDYKVPSKKMKVLGNTDKHFIKKNLIGALLFDEGTTA--EDRRLKRTARRRYT    74
WP_049538452    1  SNKP-YSIGLDIGTNSVGWVIITDDYKVPSKKMKVLGNTDKHFIKKNLIGALLFDEGTTA--EDRRLKRTARRRYT    74
WP_049549711    1  SNKP-YSIGLDIGTNSVGWAVITDDYKVPSKKMTVLGNTDKHFIKKNLIGALLFDEGTTA--EDRRLKRTARRRYT    74
WP_007896501    1  --YS-YSIGLDIGTNSVGWAVINEDYKVPAKKMTVFGNTDRKTIKKNLLGTVLFDSGETA--QARRLKRTNRRRYT    75
EFR44625        1  ------------------------------MLGTVLFDSGETA--QARRLKRTNRRRYT    27
WP_002897477    1  K-KP-YSIGLDIGTNSVGWAVVTDDYKVPAKKMRVFGDTDRSHIKKNLLGTLLFDDGNTA--ESRRLKRTARRRYT    73
WP_002906454    1  K-KP-YSIGLDIGTNSVGWAVITDDYKVPSKKMKVLGNTDKHFIKKNLIGALLFDEGTTA--EDRRLKRTSRRRYT    73
```

```
WP_009729476   1   ENKN-YSIGLDIGTNSVGWSVITDDYKVPSKKMKVLGNTDKHFIKKNLIGALLFDEGTTA--EARRLKRTARRRYT   74
CQR24647       1   MKKP-YSIGLDIGTNSVGWSVVTDDYKVPAKKMKVLGNTDKEYIKKNLIGALLFDSGETA--EATRMKRTARRRYT   73
WP_000066813   1   SNKS-YSIGLDIGTNSVGWAVITDDYKVPSKKMKVLGNTDKHFIKKNLIGALLFDEGTTA--EDRRLKRTARRRYT   74
WP_009754323   1   NNNN-YSIGLDIGTNSVGWAVITDDYKVPSKKMRVLGNTDKRFIKKNLIGALLFDEGTTA--EDRRLKRTARRRYT   74
WP_044674937   1   MKKK-YAIGIDIGTNSVGWSVVTDDYKVPSKKMKVFGNTEKRYIKKNLLGTLLFDEGNTA--ENRRLKRTARRRYT   73
WP_044676715   1   MKKK-YAIGIDIGTNSVGWSVVTDDYKVPSKKMKVFGNTEKRYIKKNLLGTLLFDEGNTA--ENRRLKRTARRRYT   73
WP_044680361   1   MKKK-YAIGIDIGTNSVGWSVVTDDYKVPSKKMKVFGNTEKRYIKKNLLGTLLFDEGNTA--ENRRLKRTARRRYT   73
WP_044681799   1   MKKK-YAIGIDIGTNSVGWSVVTDDYKVPSKKMKVFGNTEKRYIKKNLLGTLLFDEGNTA--ENRRLKRTARRRYT   73
WP_049533112   1   MDQK-YSIGLDIGTNSVGWAVVTDDYKVPAKKMKVLGNTDKQSIKKNLLGALLFDSGETA--EATRLKRTARRRYT   73
WP_029090905   1   ---------------------------------------------MWGVSLFEAGKTA--AERRGYRSTRRRLN   27
WP_006506696   1   I-VD-YCIGLDLGTGSVGWAVVDMNHRLMKRN-----------GKHLWGSRLFSNAETA--ANRRASRSIRRRYN   60
AIT42264       1   MDKK-YSIGLDIGTNSVGWAVITDEYKVPSKKFKVLGNTDRHSIKKNLIGALLFDSGETA--EATRLKRTARRRYT   73
WP_034440723   1   -MKN-YTIGLDIGTNSVGWAVIKDDLTLVRKKIKISGNTDKKEVKKNLWGSFLFEQGDTA--QDTRVKRIARRRYE   72
AKQ21048       1   MDKK-YSIGLDIGTNSVGWAVITDEYKVPSKKFKVLGNTDRHSIKKNLIGALLFDSGETA--EATRLKRTARRRYT   73
WP_004636532   1   MQKN-YTIGLDIGTNSVGWAVMKDDYTLIRKRMKVLGNTDIKKIKKNFWGVRLFDEGETA--KETRLKRGTRRRYQ   73
WP_002364836   1   MKKD-YVIGLDIGTNSVGWAVMTEDYQLVKKKMPIYGNTEKKKIKKNFWGVRLFEEGHTA--EDRRLKRTARRRIS   73
WP_016631044   1   -------------------------------------------MRLFEEGHTA--EDRRLKRTARRRIS   24
EMS75795           --------------------------------------------------------------------------
WP_002373311   1   MKKD-YVIGLDIGTNSVGWAVMTEDYQLVKKKMPIYGNTEKKKIKKNFWGVRLFEEGHTA--EDRRLKRTARRRIS   73
WP_002378009   1   MKKD-YVIGLDIGTNSVGWAVMTEDYQLVKKKMPIYGNTEKKKIKKNFWGVRLFEEGHTA--EDRRLKRTARRRIS   73
WP_002407324   1   MKKD-YVIGLDIGTNSVGWAVMTEDYQLVKKKMPIYGNTEKKKIKKNFWGVRLFEEGHTA--EDRRLKRTARRRIS   73
WP_002413717   1   MKKD-YVIGLDIGTNSVGWAVMTEDYQLVKKKMPIYGNTEKKKIKKNFWGVRLFEEGHTA--EDRRLKRTARRRIS   73
WP_010775580   1   MKKD-YVIGLDIGTNSVGWAVMTEDYQLVKKKMPIYGNTEKKKIKKNFWGVRLFEEGHTA--EDRRLKRTARRRIS   73
WP_010818269   1   MKKD-YVIGLDIGTNSVGWAVMTEDYQLVKKKMPIYGNTEKKKIKKNFWGVRLFEEGHTA--EDRRLKRTARRRIS   73
WP_010824395   1   MKKD-YVIGLDIGSNSVGWAVMTEDYQLVKKKMPIYGNTEKKKIKKNFWGVRLFEEGHTA--EDRRLKRTARRRIS   73
WP_016622645   1   MKKD-YVIGLDIGTNSVGWAVMTEDYQLVKKKMPIYGNTEKKKIKKNFWGVRLFEEGHTA--EDRRLKRTARRRIS   73
WP_033624816   1   MKKD-YVIGLDIGTNSVGWAVMTEDYQLVKKKMPIYGNTEKKKIKKNFWGVRLFEEGHTA--EDRRLKRTARRRIS   73
WP_033625576   1   MKKD-YVIGLDIGTNSVGWAVMTEDYQLVKKKMPIYGNTEKKKIKKNFWGVRLFEEGHTA--EDRRLKRTARRRIS   73
WP_033789179   1   MKKD-YVIGLDIGTNSVGWAVMTEDYQLVKKKMPIYGNTEKKKIKKNFWGVRLFEEGHTA--EDRRLKRTARRRIS   73
WP_002310644   1   MKKE-YTIGLDIGTNSVGWSVLTDDYRLVSKKMKVAGNTEKSSTKKNFWGVRLFDEGQTA--EARRSKRTARRRLA   73
WP_002312694   1   MKKE-YTIGLDIGTNSVGWSVLTDDYRLVSKKMKVAGNTEKSSTKKNFWGVRLFDEGQTA--EARRSKRTARRRLA   73
WP_002314015   1   MKKE-YTIGLDIGTNSVGWSVLTDDYRLVSKKMKVAGNTEKSSTKKNFWGVRLFDEGQTA--EARRSKRTARRRLA   73
WP_002320716   1   MKKE-YTIGLDIGTNSVGWSVLTDDYRLVSKKMKVAGNTEKSSTKKNFWGVRLFDEGQTA--EARRSKRTARRRLA   73
WP_002330729   1   MKKE-YTIGLDIGTNSVGWSVLTDDYRLVSKKMKVAGNTEKSSTKKNFWGVRLFDEGQTA--EARRSKRTARRRLA   73
WP_002335161   1   MKKE-YTIGLDIGTNSVGWSVLTDDYRLVSKKMKVAGNTEKSSTKKNFWGVRLFDEGQTA--EARRSKRTARRRLA   73
WP_002345439   1   MKKE-YTIGLDIGTNSVGWSVLTDDYRLVSKKMKVAGNTEKSSTKKNFWGVRLFDEGQTA--EARRSKRTARRRLA   73
WP_034867970   1   MTKD-YTIGLDIGTNSVGWAVLTDDYQLMKRKMSVHGNTEKKKIKKNEWGARLFDEGQTA--EFRRTKRINRRRLA   73
WP_047937432   1   MKKE-YTIGLDIGTNSVGWSVLTDDYRLVSKKMKVAGNTEKSSTKKNFWGVRLFDEGQTA--EARRSKRTARRRLA   73
WP_010720994   1   MTKD-YTIGLDIGTNSVGWAVLTDDYQLMKRKMSVHGNTEKKKIKKNEWGARLFDEGQTA--EFRRTKRINRRRLA   73
WP_010737004   1   MTKD-YTIGLDIGTNSVGWAVLTDDYQLMKRKMSVHGNTEKKKIKKNEWGARLFDEGQTA--EFRRTKRINRRRLA   73
```

-continued

```
WP_034700478    1  MTKD-YTIGLDIGTNSVGWAVLTDDYQLMKRKMSVHGNTEKKKIKKNEWGARLEDEGQTA--EFRRTKRINRRRLA    73
WP_007209003    1  MKND-YTIGLDIGTNSVGYSVVIDDYKVISKKMNVFGNTEKKSIKKNFWGVRLFESGQTA--QEARMKRTSRRRIA    73
WP_023519017    1  MEKE-YTIGLDIGTNSVGWAVLTDDYRLVARKMSIQGDSNRKKIKKNEWGARLFEEGKTA--QFRRIKRINRRRIA    73
WP_010770040    1  MKKE-YTIGLDIGTNSVGWAVLTENYDLVKKKMKVYGNTETKYLKKNLWGVRLFDEGETA--ADRRLKRTTRRRYS    73
WP_048604708    1  MGKE-YTIGLDIGTNSVGWAVLQEDLDLVRRKMKVYGNTEKNYLKKNFWGVDLFDEGMTA--KDTRLKRTTRRRYF    73
WP_010750235    1  MNKA-YTLGLDIGTNSVGWAVVTDDYRLMAKKMPVHSKMEKKKIKKNFWGARLFDEGQTA--EERRNKRATRRRLR    73
AII16583        1  ADKK-YSIGLDIGTNSVGWAVITDEYKVPSKKFKVLGNTDRHSIKKNLIGALLFDSGETA--EATRLKRTARRRYT   112
WP_029073316    1  NNKI-YNIGLDIGDASVGWAVVDEHYNLLKRH-----------GKHMWGSRLFTQANTA--VERRSSRSTRRRYN    65
WP_031589969    1  NNKI-YNIGLDIGDASVGWAVVDEHYNLLKRH-----------GKHMWGSRLFTQANTA--VERRSSRSTRRRYN    65
KDA45870        1  LKKD-YSIGLDIGTNSVGHAVVTDDYKVPTKKMKVFGDTSKKTIKKNMLGVLLFNEGQTA--ADTRLKRGARRRYT    74
WP_039099354    1  MSRP-YNIGLDIGTSSIGWSVVDDQSKLVSVR-----------GKYGYGVRLYDEGQTA--AERRSFRTTRRRLK    61
AKP02966        1  KEQP-YNIGLDIGTGSVGWAVINDNYDLLNIK-----------KKNLWGVRLFEGAQTA--KETRLNRSTRRRYR    64
WP_010991369    1  MKKP-YTIGLDIGTNSVGWAVLTDQYDLVKRKMKIAGDSEKKQIKKNFWGVRLFDEGQTA--ADRRMARTARRRIE    73
WP_033838504    1  MKKP-YTIGLDIGTNSVGWAVLTDQYDLVKRKMKIAGDSEKKQIKKNFWGVRLFDEGQTA--ADRRMARTARRRIE    73
EHN60060        1  MKKP-YTIGLDIGTNSVGWAVLTDQYDLVKRKMKIAGDSEKKQIKKNFWGVRLFDEGQTA--ADRRMARTARRRIE    76
EFR89594           ----------------------------------------------------------------------------
WP_038409211    1  MRKP-YTIGLDIGTNSVGWAVLTDQYNLVKRKMKVAGSAEKKQIKKNFWGVRLFDEGEVA--AGRRMNRTTRRRIE    73
EFR95520           ----------------------------------------------------------------------------
WP_003723650    1  MKNP-YTIGLDIGTNSVGWAVLTNQYDLVKRKMKVAGNSDKKQIKKNFWGVRLFDDGQTA--VDRRMNRTARRRIE    73
WP_003727705    1  MKNP-YTIGLDIGTNSVGWAVLTDQYDLVKRKMKVAGNSDKKQIKKNFWGVRLFDDGQTA--VDRRMNRTARRRIE    73
WP_003730785    1  MKNP-YTIGLDIGTNSVGWAVLTDQYDLVKRKMKVAGNSDKKQIKKNFWGVRLFDDGQTA--VDRRMNRTARRRIE    73
WP_003733029    1  MKKP-YTIGLDIGTNSVGWAVLTDQYDLVKRKMKISGDSEKKQIKKNFWGVRLFEKGETA--AKRRMSRTARRRIE    73
WP_003739838    1  MKNP-YTIGLDIGTNSVGWAVLTDQYDLVKRKMKVAGNSDKKQIKKNFWGVRLFDEGETA--ADRRMNRTARRRIE    73
WP_014601172    1  MKNP-YTIGLDIGTNSVGWAVLINQYDLVKRKMKVAGNSDKKQIKKNFWGVRLFDDGQTA--VDRRMNRTARRRIE    73
WP_023548323    1  MKNP-YTIGLDIGTNSVGWAVLINQYDLVKRKMKVAGNSDKKQIKKNFWGVRLFDDGQTA--VDRRMNRTARRRIE    73
WP_031665337    1  MKNP-YTIGLDIGTNSVGWAVLTDQYDLVKRKMKVAGNSDKKQIKKNFWGVRLFDDGQTA--VDRRMNRTARRRIE    73
WP_031669209    1  MKKP-YTIGLDIGTNSVGWAVLTDQYDLVKRKMKISGDSEKKQIKKNFWGVRLFEKGETA--AKRRMSRTARRRIE    73
WP_033920898    1  MKNP-YTIGLDIGTNSVGWAVLINQYDLVKRKMKVAGNSDKKQIKKNFWGVRLFDDGQTA--VDRRMNRTARRRIE    73
AKI42028        1  MKNP-YTIGLDIGTNSVGWAVLINQYDLVKRKMKVAGNSDKKQIKKNFWGVRLFDDGQTA--VDRRMNRTARRRIE    76
AKI50529        1  MKNP-YTIGLDIGTNSVGWAVLINQYDLVKRKMKVAGNSDKKQIKKNFWGVRLFDDGQTA--VDRRMNRTARRRIE    76
EFR83390           ----------------------------------------------------------------------------
WP_046323366    1  MKKP-YTIGLDIGTNSVGWAALTDQYDLVKRKMKVAGNSEKKQIKKNLWGVRLVDEGKTA--AHRRVNRTTRRRIE    73
AKE81011        1  ADKK-YSIGLDIGTNSVGWAVITDEYKVPSKKFKVLGNTDRHSIKKNLIGALLFDSGETA--EATRLKRTARRRYT    89
CUO82355        1  I-VD-YCIGLDLGTGSVGWAVVDMNHRLMKRN-----------GKHLWGSRLFSNAETA--ATRRSSRSIRRRYN    64
WP_033162887    1  KDIR-YSIGLDIGTNSVGWAVMDEHYELLKKG-----------NHHMWGSRLFDAAEPA--ATRRASRSIRRRYN    65
AGZ01981        1  ADKK-YSIGLDIGTNSVGWAVITDEYKVPSKKFKVLGNTDRHSIKKNLIGALLFDSGETA--EATRLKRTARRRYT   106
AKA60242        1  MDKK-YSIGLAIGTNSVGWAVITDEYKVPSKKFKVLGNTDRHSIKKNLIGALLFDSGETA--EATRLKRTARRRYT    73
AKS40380        1  MDKK-YSIGLDIGTNSVGWAVITDEYKVPSKKFKVLGNTDRHSIKKNLIGALLFDSGETA--EATRLKRTARRRYT    73
4UN5_B          1  MDKK-YSIGLAIGTNSVGWAVITDEYKVPSKKFKVLGNTDRHSIKKNLIGALLFDSGETA--EATRLKRTARRRYT    77
WP_010922251   74  RRKNRICYLQEIFSNEMAKVDDSFFHRLEE-SFLV--EEDKK---H ERHPIFGNIV-DEVAYHEKYPTIYHLRKLV  143
```

```
WP_039695303  75  RRKNRLRYLQEIFANEIAKVDESFFQRLDE-SFLT--DDDKT---F DSHPIFGNKA-EEDAYHQKFPTIYHLRKHLA  144
WP_045635197  74  RRKNRLRYLQEIFSEEMSKVDSSFFHRLDD-SFLI--PEDKR---E SKYPIFATLT-EEKEYHKQFPTIYHLRKQLA  143
5AXW_A        62  RRRHRIQRVKKLLFD--------YNLLTDhSELS----------G --NPYEARVK--------------GLSQKLS  104
WP_009880683      ---------------------------------------------- ------------------------------
WP_010922251  74  RRKNRICYLQEIFSNEMAKVDDSFFHRLEE-SFLV--EEDKK---H ERHPIFGNIV-DEVAYHEKYPTIYHLRKKLV  143
WP_011054416  74  RRKNRICYLQEIFSNEMAKVDDSFFHRLEE-SFLV--EEDKK---H ERHPIFGNIV-DEVAYHEKYPTIYHLRKKLA  143
WP_011284745  74  RRKNRICYLQEIFSNEMAKVDDSFFHRLEE-SFLV--EEDKK---H ERHPIFGNIV-DEVAYHEKYPTIYHLRKKLA  143
WP_011285506  74  RRKNRICYLQEIFSNEMAKVDDSFFHRLEE-SFLV--EEDKK---H ERHPIFGNIV-DEVAYHEKYPTIYHLRKKLV  143
WP_011527619  74  RRKNRICYLQEIFSNEMAKVDDSFFHRLEE-SFLV--EEDKK---H ERHPIFGNIV-DEVAYHEKYPTIYHLRKKLV  143
WP_012560673  74  RRKNRICYLQEIFSNEIAKVDDSFFHRLEE-SFLV--EEDKK---H ERHPIFGNIV-DEVAYHEKYPTIYHLRKKLA  143
WP_014407541  74  RRKNRICYLQEIFSNEMAKVDDSFFHRLEE-SFLV--EEDKK---H ERHPIFGNIV-DEVAYHEKYPTIYHLRKKLA  143
WP_020905136  74  RRKNRICYLQEIFSNEMAKVDDSFFHRLEE-SFLV--EEDKK---H ERHPIFGNIV-DEVAYHEKYPTIYHLRKKLV  143
WP_023080005  74  RRKNRICYLQEIFSNEMAKVDDSFFHRLEE-SFLV--EEDKK---H ERHPIFGNIV-DEVAYHEKYPTIYHLRKKLA  143
WP_023610282  74  RRKNRICYLQEIFSNEMAKVDDSFFHRLEE-SFLV--EEDKK---H ERHPIFGNIV-DEVAYHEKYPTIYHLRKKLA  143
WP_030125963  74  RRKNRICYLQEIFSNEMAKVDDSFFHRLEE-SFLV--EEDKK---H ERHPIFGNIV-DEVAYHEKYPTIYHLRKKLV  143
WP_030126706  74  RRKNRICYLQEIFSNEMAKVDDSFFHRLEE-SFLV--EEDKK---H ERHPIFGNIV-DEVAYHEKYPTIYHLRKKLA  143
WP_031488318  74  RRKNRICYLQEIFSNEMAKVDDSFFHRLEE-SFLV--EEDKK---H ERHPIFGNIV-DEVAYHEKYPTIYHLRKKLA  143
WP_032460140  74  RRKNRICYLQEIFSNEIAKVDDSFFHRLEE-SFLV--EEDKK---H ERHPIFGNIV-DEVAYHEKYPTIYHLRKKLA  143
WP_032461047  74  RRKNRICYLQEIFSNEIAKVDDSFFHRLEE-SFLV--EEDKK---H ERHPIFGNIV-DEVAYHEKYPTIYHLRKKLA  143
WP_032462016  74  RRKNRICYLQEIFSNEMAKVDDSFFHRLEE-SFLV--EEDKK---H ERHPIPGNIV-DEVAYHEKYPTIYHLRKKLV  143
WP_032462936  74  RRKNRICYLQEIFSNEMAKVDDSFFHRLEE-SFLV--EEDKK---H ERHPIFGNIV-DEVAYHEKYPTIYHLRKKLA  143
WP_032464890  74  RRKNRICYLQEIFSNEMAKVDDSFFHRLEE-SFLV--EEDKK---H ERHPIFGNIV-DEVAYHEKYPTIYHLRKKLV  143
WP_033888930      ---------------------------------------------- ------------------------------
WP_038431314  74  RRKNRICYLQEIFSNEMAKVDDSFFHRLEE-SFLV--EEDKK---H ERHPIFGNIV-DEVAYHEKYPTIYHLRKKLA  143
WP_038432938  74  RRKNRICYLQEIFSNEMAKVDDSFFHRLEE-SFLV--EEDKK---H ERHPIFGNIV-DEVAYHEKYPTIYHLRKKLA  143
WP_038434062  74  RRKNRICYLQEIFSNEMAKVDDSFFHRLEE-SFLV--EEDKK---H ERHPIFGNIV-DEVAYHEKYPTIYHLRKKLA  143
BAQ51233       1  ----------------MAKVDDSFFHRLEE-SFLV--EEDKK---H ERHPIFGNIV-DEVAYHEKYPTIYHLRKKLV   54
KGE60162          ---------------------------------------------- ------------------------------
KGE60856          ---------------------------------------------- ------------------------------
WP_002989955  74  RRKNRICYLQEIFSNEMAKVDDSFFHRLEE-SFLV--EEDKK---H ERHPIFGNIV-DEVAYHEKYPTIYHLRKKLV  143
WP_003030002  74  RRRNRLRYLQEIFAEEMNKVDENFFQRLDD-SFLV--DEDKR---G ERHPIFGNIA-AEVKYHDDFPTIYHLRKHLA  143
WP_003065552  75  RRKNRLRYLQEIFAEEMTKVDESFFQRLDE-SFLRwdDDNKK---L GRYPIFGNKA-DVVKYHQEFPTIYHLRKHLA  146
WP_001040076  74  RRRNRILYLQEIFAEEMSKVDDSFFHRLED-SFLV--EEDKR---G SKYPIFATLQ-EEKYYHEKFPTIYHLRKELA  143
WP_001040078  74  RRRNRILYLQEIFAEEMSKVDDSFFHRLED-SFLV--EEDKR---G SKYPIFATLQ-EEKDYHEKFPTIYHLRKELA  143
WP_001040080  74  RRRNRILYLQEIFAEEMSKVDDSFFHRLED-SFLV--EEDKR---G SKYPIFATLQ-EEKDYHEKFSTIYHLRKELA  143
WP_001040081  74  RRRNRILYLQEIFAEEMSKVDDSFFHRLED-SELV--EEDKR---G SKYPIFATLQ-EEKDYHEKFSTIYHLRKELA  143
WP_001040083  74  RRRNRILYLQEIFAEEMSKVDDSFFHRLED-SFLV--EEDKR---G SKYPIFATLQ-EEKDYHEKFSTIYHLRKELA  143
WP_001040085  74  RRRNRILYLQEIFAEEMSKVDDSFFHRLED-SFLV--EEDKR---G SKYPIFATLQ-EEKDYHEKFSTIYHLRKELA  143
WP_001040087  74  RRRNRILYLQEIFAEEMSKVDDSFFHRLED-SFLV--EEDKR---G SKYPIFATLQ-EEKDYHEKFSTIYHLRKELA  143
WP_001040088  74  RRRNRILYLQEIFAEEMSKVDDSFFHRLED-SFLV--EEDKR---G SKYPIFATLQ-EEKDYHEKFSTIYHLRKELA  143
WP_001040089  74  RRRNRILYLQEIFAEEMSKVDDSFFHRLED-SFLV--EEDKR---G SKYPIFATLQ-EEKDYHEKFSTIYHLRKELA  143
```

-continued

```
WP_001040090    74  RRRNRILYLQEIFAEEMSKVDDSFFHRLED-SELV--EEDKR---G SKYPIFATLQ-EEKDYHEKFSTIYHLRKELA   143
WP_001040091    74  RRRNRILYLQEIFAEEMSKVDDSFFHRLED-SFLV--EEDKR---G SKYPIFATLQ-EEKDYHEKFSTIYHLRKELA   143
WP_001040092    74  RRRNRILYLQEIFAEEMSKVDDSFFHRLED-SFLV--EEDKR---G SKYPIFATMQ-EEKDYHEKFSTIYHLRKELA   143
WP_001040094    74  RRRNRILYLQEIFAEEMSKVDDSFFHRLED-SELV--EEDKR---G SKYPIFATMQ-EEKYYHEKFSTIYHLRKELA   143
WP_001040095    74  RRRNRILYLQEIFAEEMSKVDDSFFHRLED-SFLV--EEDKR---G SKYPIFATMQ-EEKYYHEKFSTIYHLRKELA   143
WP_001040096    74  RRRNRILYLQEIFAEEMSKVDDSFFHRLED-SFLV--EEDKR---G SKYPIFATMQ-EEKYYHEKFSTIYHLRKELA   143
WP_001040097    74  RRRNRILYLQEIFAEEMSKVDDSFFHRLED-SFLV--EEDKR---G SKYPIFATMQ-EEKYYHEKFSTIYHLRKELA   143
WP_001040098    74  RRRNRILYLQEIFAEEMSKVDDSFFHRLED-SFLV--EEDKR---G SKYPIFATMQ-EEKYYHEKFSTIYHLRKELA   143
WP_001040099    74  RRRNRILYLQEIFAEEMSKVDDSFFHRLED-SFLV--EEDKR---G SKYPIFATMQ-EEKYYHEKFSTIYHLRKELA   143
WP_001040100    74  RRRNRILYLQEIFAEEMSKVDDSFFHRLED-SFLV--EEDKR---G SKYPIFATMQ-EEKYYHEKFSTIYHLRKELA   143
WP_001040104    74  RRRNRILYLQEIFAEEMSKVDDSFFHRLED-SFLV--EEDKR---G SKYXIFATLQ-EEKDYHEKFSTIYHLRKELA   143
WP_001040105    74  RRRNRILYLQEIFAEEMSKVDDSFFHRLED-SELV--EEDKR---G SKYPIFATLQ-EEKDYHEKFSTIYHLRKELA   143
WP_001040106    74  CRRNRILYLQEIFAEEMSKVDDSFFHRLED-SFLV--EDDKR---G SKYPIFATMQ-EEKDYHEKFPTIYHLRKELA   143
WP_001040107    74  RRRNRILYLQEIFAEEMSKVDDSFFHRLED-SELV--EDDKR---G SKYPIFATMQ-EEKDYHEKFPTIYHLRKELA   143
WP_001040108    74  RRRNRILYLQEIFAEEMSKVDDSFFHRLED-SFLV--EDDKR---G SKYPIFATMQ-EEKDYHEKFPTIYHLRKELA   143
WP_001040109    74  RRRNRILYLQEIFAEEMSKVDDSFFHRLED-SFLV--EDDKR---G SKYPIFATMQ-EEKDYHEKFPTIYHLRKELA   143
WP_001040110    74  RRRNRILYLQEIFAEEMSKVDDSFFHRLED-SFLV--EDDKR---G SKYPIFATMQ-EEKDYHEKFPTIYHLRKELA   143
WP_015058523    74  RRRNRILYLQEIFAEEMSKVDDSFFHRLED-SELV--EEDKR---G SKYPIFATMQ-EEKDYHEKFPTIYHLRKELA   143
WP_017643650    74  RRRNRILYLQEIFAEEMSKVDDSFFHRLED-SELV--EEDKR---G SKYPIFATMQ-EEKYYHEKFPTIYHLRKELA   143
WP_017647151    74  RRRNRILYLQEIFAEEMSKVDDSFFHRLED-SFLV--EEDKR---G SKYPIFATMQ-EEKDYHEKFPTIYHLRKELA   143
WP_017648376    74  RRRNRILYLQEIFAEEMSKVDDSFFHRLED-SFLV--EEDKR---G SKYPIFATMQ-EEKDYHEKFPTIYHLRKELA   143
WP_017649527    74  RRRNRILYLQEIFAEEMSKVDDSFFHRLED-SFLV--EEDKR---G SKYPIFATLQ-EEKDYHEKFPTIYHLRKELA   143
WP_017771611    74  RRRNRILYLQEIFAEEMSKVDDSFFHRLED-SFLV--EDDKR---G SKYPIFATMQ-EEKDYHEKFPTIYHLRKELA   143
WP_017771984    74  RRRNRILYLQEIFAEEMSKVDDSFFHRLED-SFLV--EEDKR---G SKYPIFATLQ-EEKDYHEKFPTIYHLRKELA   143
CFQ25032        74  RRRNRILYLQEIFAEEMSKVDDSFFHRLED-SFLV--EEDKR---G SKYPIFATLQ-EEKDYHEKFPTIYHLRKELA   143
CFV16040        74  RRRNRILYLQEIFAEEMSKVDDSFFHRLED-SFLV--EEDKR---G SKYPIFATLQ-EEKDYHEKFPTIYHLRKELA   143
KLJ37842        74  RRRNRILYLQEIFAEEMSKVDDSFFHRLED-SFLV--EEDKR---G SKYPIFATLQ-EEKDYHEKFPTIYHLRKELA   143
KLJ72361        74  RRRNRILYLQEIFAEEMSKVDDSFFHRLED-SFLV--EEDKR---G SKYPIFATLQ-EEKDYHEKFPTIYHLRKELA   143
KLL20707        74  RRRNRILYLQEIFAEEMSKVDDSFFHRLED-SFLV--EEDKR---G SKYPIFATLQ-EEKDYHEKFPTIYHLRKELA   143
KLL42645        74  RRRNRILYLQEIFAEEMSKVDDSFFHRLED-SFLV--EDDKR---G SKYPIFATMQ-EEKDYHEKFPTIYHLRKELA   143
WP_047207273    74  RRRNRILYLQEIFAEEMSKVDDSFFHRLED-SFLV--EEDKR---G SKYPIFATLQ-EEKDYHEKFPTIYHLRKELA   143
WP_047209694    74  RRRNRILYLQEIFAEEMSKVDDSFFHRLED-SFLV--EEDKR---G SKYPIFATMQ-EEKYYHEKFPTIYHLRKELA   143
WP_050198062    74  RRRNRILYLQEIFAEEMSKVDDSFFHRLED-SFLV--EEDKR---G SKYPIFATLQ-EEKDYHEKFPTIYHLRKELA   143
WP_050201642    74  RRRNRILYLQEIFAEEMSKVDDSFFHRLED-SFLV--EEDKR---G SKYPIFATLQ-EEKDYHEKFPTIYHLRKELA   143
WP_050204027    74  RRRNRILYLQEIFAEEMSKVDDSFFHRLED-SFLV--EEDKR---G SKYPIFATMQ-EEKDYHEKFPTIYHLRKELA   143
WP_050881965    74  RRRNRILYLQEIFAEEMSKVDDSFFHRLED-SELV--EEDKR---G SKYPIFATLQ-EEKDYHEKFPTIYHLRKELA   143
WP_050886065    74  RRRNRILYLQEIFAEEMSKVDDSFFHRLED-SFLV--EEDKR---G SKYPIFATLQ-EEKDYHEKFPTIYHLRKELA   143
AHN30376        74  RRRNRILYLQEIFAEEMSKVDDSFFHRLED-SFLV--EEDKR---G SKYPIFATMQ-EEKDYHEKFPTIYHLRKELA   143
EAO78426        74  RRRNRILYLQEIFAEEMSKVDDSFFHRLED-SFLV--EEDKR---G SKYPIFATLQ-EEKDYHEKFPTIYHLRKELA   143
CCW42055        74  RRRNRILYLQEIFAEKMSKVDDSFFHRLED-SFLV--EEDKR---G SKYPIFATLQ-EEKDYHEKFPTIYHLRKELA   143
```

-continued

```
WP_003041502    74 RRRNRLRYLQEIFAEEMMQVDESFFQRLDD-SFLV--DEDKR---G ERHPIFGNIA-AEVKYHDEFPTIYHLRKHLA 143
WP_037593752    75 RRKNRLRYLQEIFTEEMNKVDENFFQRLDD-SFLV--EEDKQ---G SKYPIFGTLK-EEKEYHKKFKTIYHLREELA 144
WP_049516684    75 RRKNRLRYLQEIFAEEMMQVDESFFQRLDD-SFLV--EEDKR---G SRYPIFGNIA-AEVKYHDDFPTIYHLRKHLV 144
GAD46167        74 RRKNRLRYLQEIFTEEMNKVDENFFQRLDD-SFLV--EEDKQ---G SKYPIFGTLK-EEKEYHKKFKTIYHLREELA 143
WP_018363470    75 RRKNRLRYLQDIFTEEMAKVDDSFFQRLDE-SFLT--DNDKN---F DSHPIFGNKA-EEDAYHQKFPTIYHLRKHLA 144
WP_003043819    74 RRKNRIRYLQEIFANEMAKLDDSFFQRLEE-SFLV--EEDKK---N ERHPIFGNIA-DEVAYHRNYPTIYHLRKKLA 143
WP_006269658    74 RRKNRLRYLQEIFTGEMNKVDENFFQRLDD-SFLV--DEDKR---G EHHPIFGNIA-AEVKYHDDFPTIYHLRRHLA 143
WP_048800889    74 RRKNRLRYLQEIFIEEMNKVDENFFQRLDD-SFLV--TEDKR---G SKYPIFGTLK-EEKEYYKEFETIYHLRKRLA 143
WP_012767106    74 RRKNRIRYLQEIFSSEMSKVDDSFFHRLEE-SFLV--EEDKK---H ERHPIFGNIV-DEVAYHEKYPTIYHLRKKLA 143
WP_014612333    74 RRKNRIRYLQEIFSSEMSKVDDSFFHRLEE-SFLV--EEDKK---H ERHPIFGNIV-DEVAYHEKYPTIYHLRKKLA 143
WP_015017095    74 RRKNRIRYLQEIFSSEMSKVDDSFFHRLEE-SFLV--EEDKK---H ERHPIFGNIV-DEVAYHEKYPTIYHLRKKLA 143
WP_015057649    74 RRKNRIRYLQEIFSSEMSKVDDSFFHRLEE-SFLV--EEDKK---H ERHPIFGNIV-DEVAYHEKYPTIYHLRKKLA 143
WP_048327215    74 RRKNRIRYLQEIFSSEMSKVDDSFFHRLEE-SFLV--EEDKK---H ERHPIFGNIV-DEVAYHEKYPTIYHLRKKLA 143
WP_049519324    74 RRKNRIRYLQEIFSSEMSKVDDSFFHRLEE-SFLV--EEDKK---H ERHPIFGNIV-DEVAYHEKYPTIYHLRKKLA 143
WP_012515931    74 RRKNRLRYLKEIFTEEMAKVDDGFFQRLED-SFYV--LEDKE---G NKHPIFANLA-DEVAYHKKYPTIYHLRKELV 143
WP_021320964    74 RRKNRLRYLKEIFTEEMAKVDDGFFQRLED-SFYV--LEDKE---G NKHPIFANLA-DEVAYHKKYPTIYHLRKELV 143
WP_037581760    74 RRKNRLRFLKEIFTEEMAKVDDGFFQRLED-SFYV--LEDKE---G NKHPIFANLA-DEVAYHKKYPTIYHLRKELV 143
WP_004232481    74 RRKNRLRYLQEIFAKEMAKVDESFFQRLEE-SFLT--DDDKT---F DSHPIFGNKA-EEDTYHQEFPTIYHLRKHLA 143
WP_009854540    75 RRKNRLRYLQEIFAEEMTKVDESFFYRLDE-SFLT--TDEKD---F ERHPIFGNKA-EEDAYHQKFPTIYHLRNYLA 144
WP_012962174    75 RRKNRLRYLQEIFAEEMAKVDESFFYRLDE-SFLT--TDDKD---F ERHPIFGNKA-DEIKYHQEFPTIYHLRKHLA 144
WP_039695303    75 RRKNRLRYLQEIFANEIAKVDESFFQRLDE-SFLT--DDDKT---F DSHPIFGNKA-EEDAYHQKFPTIYHLRKHLA 144
WP_014334983    74 RRKNRLRYLQEIFAKEMTKVDESFFQRLEE-SFLT--DDDKT---F DSHPIFGNKA-EEDAYHQKFPTIYHLRKYLA 143
WP_003099269    74 RRKYRIKELQKIFSSEMNELDIAFFPRLSE-SFLV--SDDKE---F ENHPIFGNLK-DEITYHNDYPTIYHLRQTLA 143
AHY15608        74 RRKYRIKELQKIFSSEMNELDIAFFPRLSE-SFLV--SDDKE---F ENHPIFGNLK-DEITYHNDYPTIYHLRQTLA 143
AHY17476        74 RRKYRIKELQKIFSSEMNELDIAFFPRLSE-SFLV--SDDKE---F ENHPIFGNLK-DEITYHNDYPTIYHLRQTLA 143
ESR09100           -------------------------------------------------- ------------------------------
AGM98575        74 RRKYRIKELQKIFSSEMNELDIAFFPRLSE-SFLV--SDDKE---F ENHPIFGNLK-DEITYHNDYPTIYHLRQTLA 143
ALF27331        74 RRRNRILYLQEIFSEEMGKVDDSFFHRLED-SFLV--TEDKR---G ERHPIFGNLE-EEVKYHENFPTIYHLRQYLA 143
WP_018372492    74 RRRNRIRYLQHIFAEEMNRADENFFHRLKE-SFFV--EEDKT---Y SKYPIFGTLE-EEKNYHKNYPTIYHLRKTLA 143
WP_045618028    75 RRKNRLRYLQEIFTEEMSKVDISFFHRLDD-SFLV--PEDKR---G SKYPIFATLE-EEKEYHKNFPTIYHLRKHLA 144
WP_045635197    74 RRKNRLRYLQEIFSEEMSKVDSSFFHRLDD-SFLI--PEDKR---E SKYPIFATLT-EEKEYHKQFPTIYHLRKQLA 143
WP_002263549    74 RRRNRILYLQEIFSEEMGKVDDSFFHRLED-SFLV--TEDKR---G ERHPIFGNLE-EEVKYHENFPTIYHLRQYLA 143
WP_002263887    74 RRRNRILYLQEIFSEEMGKVDDSFFHRLED-SFLV--TEDKR---G ERHPIFGNLE-EEVKYHENFPTIYHLRQYLA 143
WP_002264920    74 RRRNRILYLQEIFSEEMGKVDDSFFHRLDE-SFLT--DDDKN---F DSYPIFGNKA-EEDAYHQKFPTIYHLRKHLA 143
WP_002269043    74 RRRNRILYLQEIFSEEMGKVDDSFFHRLED-SFLV--TEDKR---G ERHPIFGNLE-EEVKYHENFPTIYHLRQYLA 143
WP_002269448    74 RRRNRILYLQEIFSEEMGKVDDSFFHRLED-SFLV--TEDKR---G ERHPIFGNLE-EEVKYHENFPTIYHLRQYLA 143
WP_002271977    74 RRRNRILYLQEIFSEEMGKVDDSFFHRLED-SFLV--TEDKR---G ERHPIFGNLE-EEVKYHENFPTIYHLRQYLA 143
WP_002272766    74 RRRNRILYLQEIFSEEMGKVDDSFFHRLED-SFLV--TEDKR---G ERHPIFGNLE-EEVKYHENFPTIYHLRQYLA 143
WP_002273241    74 RRRNRILYLQEIFSEEMGKVDDSFFHRLED-SFLV--TEDKR---G ERHPIFGNLE-EEVKYHENFPTIYHLRQYLA 143
WP_002275430    74 RRRNRILYLQEIFAEEMSKVDDSFFHRLED-SFLV--TEDKR---G ERHPIFGNLE-EEVKYHENFPTIYHLRQYLA 143
WP_002276448    74 RRRNRILYLQEIFSEEMGKVDDSFFHRLED-SFLV--TEDKR---G ERHPIFGNLE-EEVKYHENFPTIYHLRQYLA 143
```

-continued

```
WP_002277050     74  RRRNRILYLQEIFSEEMGKVDDSFFHRLDE-SFLT--DDDKN---F DSHPIFGNKA-EEDAYHQKFPTIYHLRKHLA   143
WP_002277364     74  RRRNRILYLQEIFAEEMSKVDDSFFHRLED-SFLV--TEDKR---G ERHPIFGNLE-EEVKYHENFPTIYHLRQYLA   143
WP_002279025     74  RRRNRILYLQEIFSEEMGKVDDSFFHRLED-FFLV--TEDKR---G ERHPIFGNLE-EEVKYHENFPTIYHLRQYLA   143
WP_002279859     74  RRRNRILYLQEIFSEEMGKVDDSFFHRLDE-SFLT--DDDKN---F DSHPIFGNKA-EEDAYHQKEPTIYHLRKHLA   143
WP_002280230     74  RRRNRILYLQEIFAEEMSKVDDSFFHRLED-SFLV--TEDKR---G ERHPIFGNLE-EEVKYHENFPTIYHLRQYLA   143
WP_002281696     74  RRRNRILYLQEIFAEEMSKVDDSFFHRLED-SFLV--TEDKR---G ERHPIFGNLE-EEVKYHENFPTIYHLRQYLA   143
WP_002282247     74  RRRNRILYLQEIFAEEMSKVDDSFFHRLDE-SFLT--DDDKN---F DSHPIFGNKA-EEDAYHQKFPTIYHLRKHLA   143
WP_002282906     74  RRRNRILYLQEIFSEEMGKVDDSFFHRLED-SFLV--TEDKR---G ERHPIFGNLE-EEVKYHENFPTIYHLRQYLA   143
WP_002283846     74  RRRNRILYLQEIFSEEMGKVDDSFFHRLED-SELV--TEDKR---G ERHPIFGNLE-EEVKYHENFPTIYHLRQYLA   143
WP_002287255     74  RRRNRILYLQEIFAEEMSKVDDSFFHRLED-SFLV--TEDKR---G ERHPIFGNLE-EEVKYHENFPTIYHLRQYLA   143
WP_002288990     74  RRRNRILYLQEIFSEEMGKVDDSFFHRLED-SFLV--TEDKR---G ERHPIFGNLE-EEVKYHENFPTIYHLRQYLA   143
WP_002289641     74  RRRNRILYLQEIFSEEMGKVDDSFFHRLED-SFLV--TEDKR---G ERHPIFGNLE-EEVKYHENFPTIYHLRQYLA   143
WP_002290427     74  RRRNRILYLQEIFSEEMGKVDDSFFHRLED-SFLV--TEDKR---G ERHPIFGNLE-EEVKYHENFPTIYHLRQYLA   143
WP_002295753     74  RRRNRILYLQEIFSEEMGKVNDSFFHRLED-SFLV--TEDKR---G ERHPIFGNLE-EEVKYHENFPTIYHLRQYLA   143
WP_002296423     74  RRRNRILYLQEIFSEEMGKVDDSFFHRLED-SFLV--TEDKR---G ERHPIFGNLE-EEVKYHENFPTIYHLRQYLA   143
WP_002304487     74  RRRNRILYLQEIFAEEMQVDESFFQRLDD-SFLV--EEDKR---G SRYPIFGTLK-EEKKYHKEFKTIYHLREKLA   143
WP_002305844     74  RRRNRILYLQEIFSEEMDKVDDSFFHRLED-SELV--TEDKR---G ERHPIFGNLE-EEVKYHENFPTIYHLRQYLA   143
WP_002307203     74  RRRNRILYLQEIFSEEMGKVDDSFFHRLED-SFLV--TEDKR---G ERHPIFGNLE-EEVKYHENFPTIYHLRQYLA   143
WP_002310390     74  RRRNRILYLQEIFSEEMGKVDDSFFHRLED-SFLV--TEDKR---G ERHPIFGNLE-EEVKYHENFPTIYHLRQYLA   143
WP_002352408     74  RRRNRILYLQEIFSEEMGKVDDSFFHRLED-SELV--TEDKR---G ERHPIFGNLE-EEVKYHENFPTIYHLRQYLA   143
WP_012997688     74  RRRNRILYLQEIFAEEMSKVDDSFFHRLED-SELV--TEDKR---G ERHPIFGNLE-EEVKYHENFPTIYHLRQYLA   143
WP_014677909     74  RRRNRILYLQEIFSEEMGKVDDSFFHRLED-SFLV--TEDKR---G ERHPIFGNLE-EEVKYHENFPTIYHLRQYLA   143
WP_019312892     74  RRRNRILYLQEIFAEEMSKVDDSFFHRLED-SFLV--TEDKR---G ERHPIFGNLE-EEVKYHENFPTIYHLRQYLA   143
WP_019313659     74  RRRNRILYLQEIFSEEMGKVDDSFFHRLED-SFLV--TEDKR---G ERHPIFGNLE-EEVKYHENFPTIYHLRQYLA   143
WP_019314093     74  RRRNRILYLQEIFSEEMGKVDDSFFHRLED-SELV--TEDKR---G ERHPIFGNLE-EEVKYHENFPTIYHLRQYLA   143
WP_019315370     74  RRRNRILYLQEIFSEEMGKVDDSFFHRLED-SFLV--TEDKR---G ECHPIFGNLE-EEVKYHENFPTIYHLRQYLA   143
WP_019803776     74  RRRNRILYLQEIFSEEMGKVDDSFFHRLED-SFLV--TEDKR---G ERHPIFGNLE-EEVKYHENFPTIYHLRQYLA   143
WP_019805234     74  RRRNRILYLQEIFSEEMGKVDDSFFHRLED-SELT--TEDKR---G ERHPIFGNLE-EEVKYHENFPTIYHLRQYLA   143
WP_024783594     74  RRRNRILYLQEIFSEEMGKVDDSFFHRLED-SELV--TEDKR---G ERHPIFGNLE-EEVKYHENFPTIYHLRQYLA   143
WP_024784288     74  RRRNRILYLQEIFAEEMSKVDDSFFHRLDE-SFLT--DDDKN---F DSHPIFGNKA-EEDAYHQKFPTIYHLRKHLA   143
WP_024784666     74  RRRNRILYLQEIFAEEMSKVDDSFFHRLED-SFLV--TEDKR---G ERHPIFGNLE-EEVKYHENFPTIYHLRQYLA   143
WP_024784894     74  RRRNRILYLQEIFSEEMGKVDDSFFHRLED-SELV--TEDKR---G ERHPIFGNLE-EEVKYHENFPTIYHLRQYLA   143
WP_024786433     74  RRRNRILYLQEIFAEEMNKVDDSFFHRLDE-SFLT--DDDKN---F DSHPIFGNKA-EEDAYHQKEPTIYHLRKHLA   143
WP_049473442     74  RRRNRILYLQEIFAEEMSKVDDSFFHRLED-SFLV--TEDKR---G ERHPIFGNLE-EEVKYYENFPTIYHLRQYLA   143
WP_049474547     74  RRRNRILYLQEIFSEEMGKVDDSFFHRLED-SFLV--TEDKR---G ERHPIFGNLE-EEVKYHENFPTIYHLRQYLA   143
EMC03581         67  RRRNRILYLQEIFAEEMSKVDDSFFHRLED-SFLV--TEDKR---G ERHPIFGNLE-EEVKYHENFPTIYHLRQYLA   136
WP_000428612     75  RRKNRLRYLQEIFAEEMSKVDSSFFHRLDD-SFLI--PEDKK---G SKYPIFATLI-EEKEYHKQFPTIYHLRKQLA   144
WP_000428613     75  RRKNRLRYLQEIFAEEMSKVDSSFFHRLDD-SFLI--PEDKR---G SKYPIFATLA-EEKEYHKQFPTIYHLRKQLA   144
WP_049523028     74  RRRNRILYLQEIFAAEMNKVDESFFHRLDD-SELV--PEDKR---G SKYPIFGTLE-EEKEYHKQFPTIYYLRKILA   143
WP_003107102     43  RRINRIKYLQSIFDDEMSKIDSAFFQRIKD-SFLV--PDDKN---D DRHPIFGNIK-DEVDYHKNYPTIYHLRKKLA   112
```

```
-continued
WP_054279288   76 RRKNRLCYLRDIFESEMHTIDKHFFLRLED-SFLH--KSDKR---Y EAHPIFGTLQ-EEKAYHDNYPTIYHLRKALA 145
WP_049531101   75 RRKNRLRYLQEIFSEEISKVDNSFFHRLDD-SFLV--PEDKR---G SKYPIFATLT-EEKEYYKQFPTIYHLRKQLA 144
WP_049538452   75 RRKNRLRYLQEIFAEEMNKVDSSFFHRLDD-SFLV--PEDKR---G SKYPIFATLA-EEKEYHKNFPTIYHLRKQLA 144
WP_049549711   75 RRKNRLRYLQEIFSGEMSKVDSSFFHRLDD-SELV--PEDKR---G SKYPIFATLV-EEKEYHKQFPTIYHLRKQLA 144
WP_007896501   76 RRRYRLCQLQNIFATEMVKVDDTFFQRLSE-SFFY--YQDKA---F DKHPIFGNSK-EERAYHKTYPTIYHLRKDLA 145
EFR44625       28 RRRYRLCQLQNIFATEMVKVDDTFFQRLSE-SFFY--YQDKA---F DKHPIFGNSK-EERAYHKTYPTIYHLRKDLA  97
WP_002897477   74 RRRNRILYLQEIFTESMNEIDESFFHRLDD-SFLV--PEDKR---G SKYPIFATLQ-EEKEYHKQFPTIYHLRKQLA 143
WP_002906454   74 RRKNRLRYLQEIFSEEISKLDSSFFHRLDD-SFLV--PEDKR---G SKYPIFATLE-EEKEYHKKFPTIYHLRKHLA 143
WP_009729476   75 RRKNRLRYLQEIFSEEIGKVDSSFFHRLDD-SFLI--PEDKR---G SKYPIFATLA-EEKKYHKQFPTIYHLRKQLA 144
CQR24647       74 RRRNRILYLQDIFSPELNQVDESFLHRLDD-SFLVa--EDKR---G ERHVIFGNIA-DEVKYHKEFPTIYHLRKHLA 143
WP_000066813   75 RRKNRLRYLQEIFSQEISKVDSSFFHRLDD-PFLV--PEDKR---G SKYPIFATLV-EEKEYHKKFPTIYHLRKHLA 144
WP_009754323   75 RRKNRLRYLQEIFAEEMSKVDSSFFHRLDD-SFLV--PEDKS---G SKYPIFATLA-EEKEYHKKFPTIYHLRKHLA 144
WP_044674937   74 RRRNRILYLQEIFAEEINKIDDSFFQRLDD-SFLIV--EDKQ---G SKHPIFGTLQ-EEKKYHKQFPTIYHLRKQLA 143
WP_044676715   74 RRRNRILYLQEIFAEEINKIDDSFFQRLDD-SFLIV--EDKQ---G SKHPIFGTLQ-EEKEYHKQFPTIYHLRKQLA 143
WP_044680361   74 RRRNRILYLQEIFAEEINKIDDSFFQRLDD-SFLIV--EDKQ---G SKHPIFGTLQ-EEKEYHKQFPTIYHLRKQLA 143
WP_044681799   74 RRRNRILYLQEIFAEEINKIDDSFFQRLDD-SFLIV--EDKQ---G SKHPIFGTLQ-EEKKYHKQFPTIYHLRKQLA 143
WP_049533112   74 RRRNRLRYLQEIFAEEMNKVDENFFQRLDD-SFLV--DEDKR---G ERHPIFGNIA-AEVKYHDDFPTIYHLRKHLA 143
WP_029090905   28 HRKFRLRLLEDMFEKEILSKDPSFFIRLKE-AFLSpkDEQKQ---F ----LENDKDyTDADYYEQYKTIYHLRYDLI 100
WP_006506696   61 KRRERIRLLRAILQDMVLEKDPTFFIRLEHtSFLD--EEDKAky1G DNYNLFIDEDENDYTYYHKYPTIYHLRKALC 139
AIT42264       74 RRKNRICYLQEIFSNEMAKVDDSFFHRLEE-SFLV--EEDKK---H ERHPIFGNIV-DEVAYHEKYPTIYHLRKKLV 143
WP_034440723   73 RRRFRIRELQKIFDKSMGEVDSNFFHRLDE-SFLV--EEDKE---Y SKYPIFSNEK-EDKNYYDKYPTIYHLRKDLA 142
AKQ21048       74 RRKNRICYLQEIFSNEMAKVDDSFFHRLEE-SFLV--EEDKK---H ERHPIFGNIV-DEVAYHEKYPTIYHLRKKLV 143
WP_004636532   74 RRRNRLIYLQDIFQQPMLAIDENFFHRLDD-SFFV--PDDKS---Y DRHPIFGSLE-EEVAYHNTYPTIYHLRKHLA 143
WP_002364836   74 RRRNRLRYLQAFFEEAMTDLDENFFARLQE-SFLV--PEDKK---W HRHPIFAKLE-DEVAYHETYPTIYHLRKKLA 143
WP_016631044   25 RRRNRLRYLQAFFEEAMTDLDENFFARLQE-SFLV--PEDKK---W HRHPIFAKLE-DEVAYHETYPTIYHLRKKLA  94
EMS75795          ------------------------------------------------ -------------------------------
WP_002373311   74 RRRNRLRYLQAFFEEAMTDLDENFFARLQE-SFLV--PEDKK---W HRHPIFAKLE-DEVAYHETYPTIYHLRKKLA 143
WP_002378009   74 RRRNRLRYLQAFFEEAMTALDENFFARLQE-SFLV--PEDKK---W HRHPIFAKLE-DEVAYHETYPTIYHLRKKLA 143
WP_002407324   74 RRRNRLRYLQAFFEEAMTALDENFFARLQE-SFLV--PEDKK---W HRHPIFAKLE-DEVAYHETYPTIYHLRKKLA 143
WP_002413717   74 RRRNRLRYLQAFFEEAMTDLDENFFARLQE-SFLV--PEDKK---W HRHPIFAKLE-DEVAYHETYPTIYHLRKKLA 143
WP_010775580   74 RRRNRLRYLQAFFEEAMTALDENFFARLQE-SFLV--PEDKK---W HRHPIFAKLE-DEVAYHETYPTIYHLRKKLA 143
WP_010818269   74 RRRNRLRYLQAFFEEAMTALDENFFARLQE-SFLV--PEDKK---W HRHPIFAKLE-DEVAYHETYPTIYHLRKKLA 143
WP_010824395   74 RRRNRLRYLQAFFEEAMTDLDENFFARLQE-SFLV--PEDKK---W HRHPIFAKLE-DEVAYHETYPTIYHLRKKLA 143
WP_016622645   74 RRRNRLRYLQAFFEEAMTALDENFFARLQE-SFLV--PEDKK---W HRHPIFAKLE-DEVAYHETYPTIYHLRKKLA 143
WP_033624816   74 RRRNRLRYLQAFFEEAMTALDENFFARLQE-SFLV--PEDKK---W HRHPIFAKLE-DEVAYHETYPTIYHLRKKLA 143
WP_033625576   74 RRRNRLRYLQAFFEEAMTALDENFFARLQE-SFLV--PEDKK---W HRHPIFAKLE-DEVAYHETYPTIYHLRKKLA 143
WP_033789179   74 RRRNRLRYLQAFFEEAMTALDENFFARLQE-SFLV--PEDKK---W HRHPIFAKLE-DEVAYHETYPTIYHLRKKLA 143
WP_002310644   74 RRRQRILELQKIFAPEILKIDEHFFARLNE-SFLV--LDEKK---Q SRHPVFATIK-QEKSYHQTYPTIYHLRQALA 143
WP_002312694   74 RRRQRILELQKIFAPEILKIDEHFFARLNE-SFLV--PDEKK---Q SRHPVFATIK-QEKSYHQTYPTIYHLRQALA 143
WP_002314015   74 RRRQRILELQKIFAPEILKIDEHFFARLNE-SFLV--LDEKK---Q SRHPVFATIK-QEKSYHQTYPTIYHLRQALA 143
WP_002320716   74 RRRQRILELQKIFAPEILKIDEHFFARLNE-SFLV--LDEKK---Q SRHPVFATIK-QEKSYHQTYPTIYHLRQALA 143
```

-continued

```
WP_002330729    74 RRRQRILELQKIFAPEILKIDEHFFARLNE-SFLV--LDEKK---Q SRHPVFATIK-QEKSYHQTYPTIYHLRQALA 143

WP_002335161    74 RRRQRILELQKIFAPEILKIDEHFFARLNE-SFLV--LDEKK---Q SRHPVFATIK-QEKSYHQTYPTIYHLRQALA 143

WP_002345439    74 RRRQRILELQKIFAPEILKIDEHFFARLNE-SFLV--LDEKK---Q SRHPVFATIK-QEKSYHQTYPTIYHLRQALA 143

WP_034867970    74 RRKYRLSKLQDLFAEELCKQDDCFFVRLEE-SFLV--PEEKQ---Y KPASIFPTLE-EEKEYYQKYPTIYHLRQKLV 143

WP_047937432    74 RRRQRILELQKIFAPEILKIDEHFFARLNE-SFLV--LDEKK---Q SRHPVFATIK-QEKSYHQTYPTIYHLRQALA 143

WP_010720994    74 RRKYRLSKLQDLFAEELCKQDDCFFVRLEE-SFLV--PEEKQ---Y KPASIFPTLE-EEKEYYQKYPTIYHLRQKLV 143

WP_010737004    74 RRKYRLSKLQDLFAEELCKQDDCFFVRLEE-SFLV--PEEKQ---Y KPASIFPTLE-EEKEYYQKYPTIYHLRQKLV 143

WP_034700478    74 RRKYRLSKLQDLFAEELCKQDDCFFVRLEE-SFLV--PEEKQ---Y KPASIFPTLE-EEKEYYQKYPTIYHLRQKLV 143

WP_007209003    74 RRKNRICYLQEIFQPEMNHLDNNFFYRLNE-SFLVa--DDAK---Y DKHPIFGTLD-EEIHFHEQFPTIYHLRKYLA 143

WP_023519017    74 RRRQRVLALQDIFAEEIHKKDPNFFARLEE-GDRV--EADKR---F AKFPVFATLS-EEKNYHRQYPTIYHLRHDLA 143

WP_010770040    74 RRRNRICRLQDLFTEEMNQVDANFFHRLQE-SFLV--PDEKE---F ERHAIFGKME-EEVSYYREFPTIYHLRKHLA 143

WP_048604708    74 RRRQRISYLQTFFQEEMNRIDPNFFNRLDE-SFLI--EEDKL---S ERHPIFGTIE-EEVAYHKNYATIYHLRKELA 143

WP_010750235    74 RRKYRILELQKIFSEEILKKDSHFFARLDE-SFLI--PEDKQ---Y ARFPIFPTLL-EEKAYYQNYPTIYHLRQKLA 143

AII16583       113 RRKNRICYLQEIFSNEMAKVDDSFFHRLEE-SFLV--EEDKK---H ERHPIFGNIV-DEVAYHEKYPTIYHLRKKLV 182

WP_029073316    66 KRRERIRLLRGIMEDMVLDVDPTFFIRLANvSFLD--QEDKKdylK SNYNLFIDKDfNDKTYYDKYPTIYHLRKHLC 144

WP_031589969    66 KRRERIRLLREIMEDMVLDVDPTFFIRLANvSFLD--QEDKKdylK SNYNLFIDKDfNDKTYYDKYPTIYHLRKHLC 144

KDA45870        75 RRKNRLRYLQEIFAPALAKVDPNFFYRLEE-SSLVa--EDKK---Y DVYPIFGKRE-EELLYHDTHKTIYHLRSELA 144

WP_039099354    62 RRKWRLGLLREIFEPYITPVDDTFFLRKKQ-SNLS--PKDQR---K -QTSLENDRT--DRAFYDDYPTIYHLRYKLM 132

AKP02966        65 RRKNRINWLNEIFSEELANTDPSFLIRLQN-SWVSkkDPDRK---R DKYNLFIDNPyTDKEYYREFPTIFHLRKELI 137

WP_010991369    74 RRRNRISYLQGIFAEEMSKTDANFFCRLSD-SFYV--DNEKR---N SRHPFFATIE-EEVEYHKNYPTIYHLREELV 143

WP_033838504    74 RRRNRISYLQGIFAEEMSKTDANFFCRLSD-SFYV--DNEKR---N SRHPFFATIE-EEVEYHKNYPTIYHLREELV 143

EHN60060        77 RRRNRISYLQGIFAEEMSKTDANFFCRLSD-SFYV--DNEKR---N SRHPFFATIE-EEVEYHKNYPTIYHLREELV 146

EFR89594           ----------------------------------------------- ------------------------------

WP_038409211    74 RRRNRIAYLQEIFAAEMAEVDANFFYRLED-SFYI--ESEKR---H SRHPFFATIE-EEVAYHEEYKTIYHLREKLV 143

EFR95520           ----------------------------------------------- ------------------------------

WP_003723650    74 RRRNRISYLQEIFAVEMANIDANFFCRLND-SFYV--DSEKR---N SRHPFFATIE-EEVAYHDNYRTIYHLREKLV 143

WP_003727705    74 RRRNRISYLQEIFAVEMANIDANFFCRLND-SFYV--DSEKR---N SRHPFFATIE-EEVAYHKNYRTIYHLREELV 143

WP_003730785    74 RRRNRISYLQEIFAVEMANIDANFFCRLND-SFYV--DSEKR---N SRHPFFATIE-EEVAYHKNYRTIYHLREELV 143

WP_003733029    74 RRRNRISYLQEIFAIQMNEVDDNFFNRLKE-SFYA--ESDKK---Y NRHPFFGTVE-EEVAYYKDFPTIYHLRKELI 143

WP_003739838    74 RRRNRISYLQEIFALEMANIDANFFCRLND-SFYV--DSEKR---N SRHPFFATIE-EEVAYHKNYRTIYHLREELV 143

WP_014601172    74 RRRNRISYLQEIFAVEMANIDANFFCRLND-SFYV--DSEKR---N SRHPFFATIE-EEVAYHKNYRTIYHLREELV 143

WP_023548323    74 RRRNRISYLQEIFAVEMANIDANFFCRLND-SFYV--DSEKR---N SRHPFFATIE-EEVAYHKNYRTIYHLREELV 143

WP_031665337    74 RRRNRISYLQEIFAVEMANIDANFFCRLND-SFYV--DSEKR---N SRHPFFATIE-EEVAYHKNYRTIYHLREELV 143

WP_031669209    74 RRRNRISYLQEIFAIQMNEVDDNFFNRLKE-SFYA--ESDKK---Y NRHPFFGTVE-EEVAYYKDFPTIYHLRKELI 143

WP_033920898    74 RRRNRISYLQEIFAVEMANIDANFFCRLND-SFYV--DSEKR---N SRHPFFATIE-EEVAYHKNYRTIYHLREELV 143

AKI42028        77 RRRNRISYLQEIFAVEMANIDANFFCRLND-SFYV--DSEKR---N SRHPFFATIE-EEVAYHKNYRTIYHLREELV 146

AKI50529        77 RRRNRISYLQEIFAVEMANIDANFFCRLND-SFYV--DSEKR---N SRHPFFATIE-EEVAYHKNYRTIYHLREELV 146

EFR83390           ----------------------------------------------- ------------------------------

WP_046323366    74 RRRNRISYLQEIFTAEMFEVDANFFYRLED-SFYI--ESEKR---Q SRHPFFATIE-EEVAYHENYRTIYHLREKLV 143

AKE81011        90 RRKNRICYLQEIFSNEMAKVDDSFFHRLEE-SFLV--EEDKK---H ERHPIFGNIV-DEVAYHEKYPTIYHLRKKLV 159
```

```
                -continued
CU082355       65  KRRERIRLLRAILQDMVLEKDPTFFIRLEHtSFLD--EEDKAky1G DNYNLFIDEDfNDYTYYHKYPTIYHLRKALC  143

WP_033162887   66  KRRERIRLLRDLLGDMVMEVDPTFFIRLLNvSFLD--EEDKQkn1G DNYNLFIEKDfNDKTYYDKYPTIYHLRKELC  144

AGZ01981      107  RRKNRICYLQEIFSNEMAKVDDSFFHRLEE-SFLV--EEDKK---H ERHPIFGNIV-DEVAYHEKYPTIYHLRKKLV  176

AKA60242       74  RRKNRICYLQEIFSNEMAKVDDSFFHRLEE-SFLV--EEDKK---H ERHPIFGNIV-DEVAYHEKYPTIYHLRKKLV  143

AKS40380       74  RRKNRICYLQEIFSNEMAKVDDSFFHRLEE-SFLV--EEDKK---H ERHPIFGNIV-DEVAYHEKYPTIYHLRKKLV  143

4UN5_B         78  RRKNRICYLQEIFSNEMAKVDDSFFHRLEE-SFLV--EEDKK---H ERHPIFGNIV-DEVAYHEKYPTIYHLRKKLV  147

WP_010922251  144  DSTDKADLRLIYLALAHMIKFRGHFLIEGD-LNPDNSDVDKL--FIQLVQTYNQL--FEEN-- INASGVDAK---AI  211

WP_039695303  145  DSSEKADLRLVYLALAHMIKFRGHFLIEGE-LNAENTDVQKI--FADFVGVYNRT--FDDS-H LSEITVDVA---SI  212

WP_045635197  144  DSKEKTDLRIYLALAHMIKYRGHFLYEEA-FDIKNNDIQKI--FNEFISIYDNT--FEGS-S LSGQNAQVE---AI  211

5AXW_A        105  EEEFSA-------ALLHLAKRRG---VHNV------NEVE------------EDT----GN-- --------E-----  134

WP_009880683       ------------------------------------------------------------- --------------

WP_010922251  144  DSTDKADLRLIYLALAHMIKFRGHFLIEGD-LNPDNSDVDKL--FIQLVQTYNQL--FEEN-- INASGVDAK---AI  211

WP_011054416  144  DSTDKVDLRLIYLALAHMIKFRGHFLIEGD-LNPDNSDVDKL--FIQLVQTYNQL--FEEN-- INASRVDAK---AI  211

WP_011284745  144  DSTDKADLRLIYLALAHMIKFRGHFLIEGD-LNPDNSDVDKL--FIQLVQTYNQL--FEEN-- INASGVDAK---AI  211

WP_011285506  144  DSTDKADLRLIYLALAHMIKFRGHFLIEGD-LNPDNSDVDKL--FIQLVQTYNQL--FEEN-- INASGVDAK---AI  211

WP_011527619  144  DSTDKADLRLIYLALAHMIKFRGHFLIEGD-LNPDNSDVDKL--FIQLVQTYNQL--FEEN-- INASGVDAK---AI  211

WP_012560673  144  DSTDKADLRLIYLALAHMIKFRGHFLIEGD-LNPDNSDVDKL--FIQLVQTYNQL--FEEN-- INASRVDAK---AI  211

WP_014407541  144  DSTDKADLRLIYLALAHMIKFRGHFLIEGD-LNPDNSDVDKL--FIQLVQIYNQL--FEEN-- INASRVDAK---AI  211

WP_020905136  144  DSTDKADLRLIYLALAHMIKFRGHFLIEGD-LNPDNSDVDKL--FIQLVQTYNQL--FEEN-- INASGVDAK---AI  211

WP_023080005  144  DSTDKVDLRLIYLALAHMIKFRGHFLIEGD-LNPDNSDVDKL--FIQLVQTYNQL--FEEN-- INASRVDAK---AI  211

WP_023610282  144  DSTDKVDLRLIYLALAHMIKFRGHFLIEGD-LNPDNSDVDKL--FIQLVQTYNQL--FEEN-- INASRVDAK---AI  211

WP_030125963  144  DSTDKADLRLIYLALAHMIKFRGHFLIEGD-LNPDNSDVDKL--FIQLVQTYNQL--FEEN-- INASGVDAK---AI  211

WP_030126706  144  DSTDKVDLRLIYLALAHMIKFRGHFLIEGD-LNPDNSDVDKL--FIQLVQTYNQL--FEEN-- INASRVDAK---AI  211

WP_031488318  144  DSTDKADLRLIYLALAHMIKERGHFLIEGD-LNPDNSDVDKL--FIQLVQTYNQL--FEEN-- INASRVDAK---AI  211

WP_032460140  144  DSTDKADLRLIYLALAHMIKFRGHFLIEGD-LNPDNSDVDKL--FIQLVQTYNQL--FEEN-- INASRVDAK---AI  211

WP_032461047  144  DSTDKADLRLIYLALAHMIKFRGHFLIEGG-LNPDNSDVDKL--FIQLVQTYNQL--FEEN-- INASRVDAK---AI  211

WP_032462016  144  DSTDKADLRLIYLALAHMIKFRGHFLIEGD-LNPDNSDVDKL--FIQLVQTYNQL--FEEN-- INANGVDAK---AI  211

WP_032462936  144  DSTDKADLRLIYLALAHMIKFRGHFLIEGD-LNPDNSDVDKL--FIQLVQTYNQL--FEEN-- INASRVDAK---AI  211

WP_032464890  144  DSTDKADLRLIYLALAHMIKFRGHFLIEGD-LNPDNSDVDKL--FIQLVQTYNQL--FEEN-- INASGVDAK---AI  211

WP_033888930    1  ------------------------PDNSDVDKL--FIQLVQTYNQL--FEEN-- INASGVDAK---AI   36

WP_038431314  144  DSTDKADLRLIYLALAHMIKFRGHFLIEGD-LNPDNSDVDKL--FIQLVQTYNQL--FEEN-- INASRVDAK---AI  211

WP_038432938  144  DSTDKVDLRLIYLALAHMIKFRGHFLIEGD-LNPDNSDVDKL--FIQLVQTYNQL--FEEN-- INASRVDAK---AI  211

WP_038434062  144  DSTDKADLRLIYLALAHMIKFRGHFLIEGD-LNPDNSDVDKL--FIQLVQTYNQL--FEEN-- INASRVDAK---AI  211

BAQ51233       55  DSTDKADLRLIYLALAHMIKFRGHFLIEGD-LNPDNSDVDKL--FIQLVQTYNQL--FEEN-- INASGVDAK---AI  122

KGE60162           ------------------------------------------------------------- --------------

KGE60856           ------------------------------------------------------------- --------------

WP_002989955  144  DSTDKADLRLIYLALAHMIKFRGHFLIEGD-LNPDNSDVDKL--FIQLVQTYNQL--FEEN-- INASGVDAK---AI  211

WP_003030002  144  DISQKADLRLVYLALAHMIKFRGHFLIEGQ-LKAENTNVQAL--FKDFVEVYDKT--VEES-H LSEMTVDAL---SI  211

WP_003065552  147  DSSEKADLRLVYLALAHMIKFRGHFLIEGE-LNAENTDVQKI--FADFVGVYDRT--FDDS-H LSEITVDAA---SI  214

WP_001040076  144  DKKEKADLRLVYLALAHIIKFRGHFLIEDDrFDVRNTDIQKQ--YQAFLEIFDTT--FENN-D LLSQDVDVE---AI  212
```

```
                -continued
WP_001040078  144 DKQEKADLRLIYLALAHIIKFRGHFLIEDDrFDVRNTDIQKQ--YQAFLEIFDTT---FENN-H LLSQNVDVE---AI  212
WP_001040080  144 DKKEKADLRLIYIALAHIIKFRGHFLIEDDsFDVRNTDISKQ--YQDFLEIFNIT---FENN-D LLSQNVDVE---AI  212
WP_001040081  144 DKKEKADLRLIYIALAHIIKFRGHFLIEDDsFDVRNTDISKQ--YQDFLEIFNTI---FENN-D LLSQNVDVE---AI  212
WP_001040083  144 DKKEKADLRLIYIALAHIIKFRGHFLIEDDsFDVRNTDISKQ--YQDFLEIFNTT---FENN-D LLSQNVDVE---AI  212
WP_001040085  144 DKKEKADLRLIYIALAHIIKFRGHFLIEDDsFDVRNTDISKQ--YQDFLEIFNTT---FENN-D LLSQNVDVE---AI  212
WP_001040087  144 DKKEKADLRLIYIALAHIIKFRGHFLIEDDsFDVRNTDISKQ--YQDFLEIFNTT---FENN-D LLSQNVDVE---AI  212
WP_001040088  144 DKKEKADLRLIYIALAHIIKFRGHFLIEDDsFDVRNTDISKQ--YQDFLEIFNTT---FENN-D LLSQNVDVE---AI  212
WP_001040089  144 DKKEKADLRLIYIALAHIIKFRGHFLIEDDsFDVRNTDISKQ--YQDFLEIFNTT---FENN-D LLSQNVDVE---AI  212
WP_001040090  144 DKKEKADLRLIYIALAHIIKFRGHFLIEDDsFDVRNTDISKQ--YQDFLEIFNTT---FENN-D LLSQNVDVE---AI  212
WP_001040091  144 DKKEKADLRLIYIALAHIIKFRGHFLIEDDsFDVRNTDISKQ--YQDFLEIFNTT---FENN-D LLSQNVDVE---AI  212
WP_001040092  144 DKKEKADLRLVYLALAHIIKFRGHFLIEDDrFDVRNTDIQKQ--YQAFLEIFDTS---FENN-H LLSQNVDVE---AI  212
WP_001040094  144 DKKEKADLRLIYLALAHIIKFRGHFLIEDDrFDVRNTDIQKQ--YQAFLEIFDTT---FENN-D LLSQNVDVE---AI  212
WP_001040095  144 DKKEKADLRLIYLALAHIIKFRGHFLIEDDrFDVRNTDIQKQ--YQAFLEIFDTT---FENN-D LLSQNVDVE---AI  212
WP_001040096  144 DKKEKADLRLIYLALAHIIKFRGHFLIEDDrFDVRNTDIQKQ--YQAFLEIFDTT---FENN-D LLSQNVDVE---AI  212
WP_001040097  144 DKKEKADLRLIYLALAHIIKFRGHFLIEDDrFDVRNTDIQKQ--YQAFLEIFDTT---FENN-D LLSQNVDVE---AI  212
WP_001040098  144 DKKEKADLRLIYLALAHIIKFRGHFLIEDDrFDVRNTDIQKQ--YQAFLEIFDTT---FENN-D LLSQNVDVE---AI  212
WP_001040099  144 DKKEKADLRLIYLALAHIIKFRGHFLIEDDrFDVRNTDIQKQ--YQAFLEIFDTT---FENN-D LLSQNVDVE---AI  212
WP_001040100  144 DKKEKADLRLIYLALAHIIKFRGHFLIEDDrFDVRNTDIQKQ--YQAFLEIFDTT---FENN-D LLSQNVDVE---AI  212
WP_001040104  144 DKKEKADLRLIYIALAHIIKFRGHFLIEDDsFDVRNTDISKQ--YQDFLEIFNTT---FENN-D LLSQNVDVE---AI  212
WP_001040105  144 DKKEKADLRLIYIALAHIIKFRGHFLIEDDsFDVRNTDISKQ--YQDFLEIFNTT---FENN-D LLSQNVDVE---AI  212
WP_001040106  144 DKKEKANLRLVYLALAHIIKFRGHFLIEDDsFDVRNTDIQRQ--YQAFLEIFDTT---FENN-H LLSQNIDVE---GI  212
WP_001040107  144 DKKEKADLRLVYLALAHIIKFRGHFLIEDDsFDVRNTDIQRQ--YQAFLEIFDTT---FENN-H LLSQNIDVE---GI  212
WP_001040108  144 DKKEKADLRLVYLALAHIIKERGHFLIEDDsFDVRNTDIQRQ--YQAFLEIFDTT---FENN-H LLSQNIDVE---GI  212
WP_001040109  144 DKKEKANLRLVYLALAHIIKFRGHFLIEDDsFDVRNTDIQRQ--YQAFLEIFDTT---FENN-H LLSQNIDVE---GI  212
WP_001040110  144 DKKEKANLRLVYLALAHIIKFRGHFLIEDDsFDVRNTDIQRQ--YQAFLEIFDTT---FENN-H LLSQNIDVE---GI  212
WP_015058523  144 DKKEKADLRLVYLALAHIIKFRGHFLIEDDrFDVRNTDIQKQ--YQAFLEIFDTS---FENN-H LLSQNVDVE---AI  212
WP_017643650  144 DKKEKADLRLIYLALAHIIKFRGHFLIEDDrFDVRNTDIQKQ--YQAFLEIFDTT---FENN-D LLSQNVDVE---AI  212
WP_017647151  144 DKKEKADLRLFYLALAHIIKFRGHFLIEDDsFDVRNTDIQRQ--YQAFLEIFDTT---FENN-H LLSQNIDIE---GI  212
WP_017648376  144 DKKEKADLRLFYLALAHIIKFRGHFLIEDDsFDVRNTDIQRQ--YQAFLEIFDTT---FENN-H LLSQNIDVE---GI  212
WP_017649527  144 DKKEKADLRLIYIALAHIIKFRGHFLIEDDsFDVRNTDISKQ--YQDFLEIFNTT---FENN-D LLSQNVDVE---AI  212
WP_017771611  144 DKKEKADLRLVYLALAHIIKFRGHFLIEDDsFDVRNTDIQRQ--YQAFLEIFDTT---FENN-H LLSQNIDVE---GI  212
WP_017771984  144 DKKEKADLRLIYIALAHIIKFRGHFLIEDDsFDVRNTDISKQ--YQDFLEIFNTT---FENN-D LLSQNVDVE---AI  212
CFQ25032      144 DKKEKADLRLIYIALAHIIKFRGHFLIEDDsFDVRNTDISKQ--YQDFLEIFNTT---FENN-D LLSQNVDVE---AI  212
CFV16040      144 DKKEKADLRLIYIALAHIIKFRGHFLIEDDsFDVRNTDISKQ--YQDFLEIFNTT---FENN-D LLSQNVDVE---AI  212
KLJ37842      144 DKKEKADLRLIYIALAHIIKFRGHFLIEDDsFDVRNTDISKQ--YQDFLEIFNTT---FENN-D LLSQNVDVE---AI  212
KLJ72361      144 DKKEKADLRLIYIALAHIIKFRGHFLIEDDsFDVRNTDISKQ--YQDFLEIFNTT---FENN-D LLSQNVDVE---AI  212
KLL20707      144 DKKEKADLRLIYIALAHIIKFRGHFLIEDDsFDVRNTDISKQ--YQDFLEIFNTT---FENN-D LLSQNVDVE---AI  212
KLL42645      144 DKKEKANLRLVYLALAHIIKFRGHFLIEDDsFDVRNTDIQRQ--YQAFLEIFDTT---FENN-H LLSQNIDVE---GI  212
WP_047207273  144 DKKEKADLRLIYLALAHIIKFRGHFLIEDDsFDVRNTDIQKQ--YQAFLEIFDTT---FENN-D LLSQNVDVE---AI  212
WP_047209694  144 DKKEKADLRLIYLALAHIIKFRGHFLIEDDsFDVRNTDIQKQ--YQAFLEIFDTT---FENN-D LLSQNVDVE---AI  212
WP_050198062  144 DKKEKADLRLIYIALAHIIKFRGHFLIEDDsFDVRNTDISKQ--YQDFLEIFNTT---FENN-D LLSQNVDVE---AI  212
```

-continued

| | | |
|---|---|---|
| WP_050201642 | 144 DKKEKADLRLIYIALAHIIKFRGHFLIEDDsFDVRNTDISKQ--YQDFLEIFNTT--FENN-D LLSQNVDVE---AI | 212 |
| WP_050204027 | 144 DKKEKANLRLVYLALAHIIKFRGHFLIEDDsFDVRNTDIQRQ--YQAFLEIFDTT--FENN-H LLSQNIDVE---GI | 212 |
| WP_050881965 | 144 DKKEKADLRLIYIALAHIIKFRGHFLIEDDsFDVRNTDISKQ--YQDFLEIFNTT--FENN-D LLSQNVDVE---AI | 212 |
| WP_050886065 | 144 DKKEKADLRLIYIALAHIIKFRGHFLIEDDsFDVRNTDISKQ--YQDFLEIFNTT--FENN-D LLSQNVDVE---AI | 212 |
| AHN30376 | 144 DKKEKADLRLVYLALAHIIKFRGHFLIEDDrFDVRNTDIQKQ--YQAFLEIFDTS--FENN-H LLSQNVDVE---AI | 212 |
| EAO78426 | 144 DKKEKADLRLIYIALAHIIKFRGHFLIEDDsFDVRNTDISKQ--YQDFLEIFNTT--FENN-D LLSQNVDVE---AI | 212 |
| CCW42055 | 144 DKKEKADLRLVYLALAHIIKFRGHFLIEDDrFDVRNTDIQKQ--YQAFLEIFDTT--FENN-H LLSQNVDVE---AI | 212 |
| WP_003041502 | 144 DISQKADLRLVYLALAHMIKFRGHFLIEGQ-LKAENTNVQAL--FKDFVEVYDKT--VEES-H LSEITVDAL---SI | 211 |
| WP_037593752 | 145 NSKEKADLRLVYLALAHMIKFRGHFLYEGD-LKAENTDVQAL--FKDFVEEYDKT--IEES-H LSEITVDAL---SI | 212 |
| WP_049516684 | 145 DISQKADLRLVYLALAHMIKFRGHFLIEGQ-LKAENTNVQAL--FKDFVEVYDKT--VEES-H LSEMTVDAL---SI | 212 |
| GAD46167 | 144 NSKEKADLRLVYLALAHMIKFRGHFLYEGD-LKAENTDVQAL--FKDFVEEYDKT--IEES-H LSEITVDAL---SI | 211 |
| WP_018363470 | 145 DSTEKADLRLVYLALAHMIKFRGHFLIEGE-LNAENTDVQKL--FTDFVGVYDRT--FDDS-H LSEITVDAA---SI | 212 |
| WP_003043819 | 144 DSPEKADLRLIYLALAHIIKFRGHFLIEGK-LNAENSDVAKL--FYQLIQTYNQL--FEES-- LDEIEVDAK---GI | 211 |
| WP_006269658 | 144 DTSKKADLRLVYLALAHMIKFRGHFLYEGD-LKAENTDVQAL--FKDFVEEYDKT--IEES-H LSEITVDAL---SI | 211 |
| WP_048800889 | 144 DSTGKVDLRLVYLALAHMIKFRGHFLIEGQ-LKAENTDVQTL--FNDFVEVYDKT--IEES-H LAEITVDAL---SI | 211 |
| WP_012767106 | 144 DSTDKADLRLIYLALAHMIKFRGHFLIEGD-LNPDNSDMDKL--FIQLVQTYNQL--FEEN-- INASRVDAK---AI | 211 |
| WP_014612333 | 144 DSTDKADLRLIYLALAHMIKFRGHFLIEGD-LNPDNSDVDKL--FIQLVQTYNQL--FEEK-- INASGVDAK---AI | 211 |
| WP_015017095 | 144 DSTDKADLRLIYLALAHMIKFRGHFLIEGD-LNPDNSDMDKL--FIQLVQTYNQL--FEEN-- INASRVDAK---AI | 211 |
| WP_015057649 | 144 DSTDKADLRLIYLALAHMIKFRGHFLIEGD-LNPDNSDMDKL--FIQLVQTYNQL--FEEN-- INASRVDAK---AI | 211 |
| WP_048327215 | 144 DSTDKADLRLIYLALAHMIKFRGHFLIEGD-LNPDNSDMDKL--FIQLVQTYNQL--FEEN-- INASRVDAK---AI | 211 |
| WP_049519324 | 144 DSTDKADLRLIYLALAHMIKFRGHFLIEGD-LNPDNSDVDKL--FIQLVQTYNQL--FEEN-- INASRVDAK---AI | 211 |
| WP_012515931 | 144 DNPQKADLRLIYLAVAHIIKFRGHFLIEGT-LSSKNNNLQKS--FDHLVDTYNLL--FEEQ-- LLTEGINAK---EL | 211 |
| WP_021320964 | 144 DNPQKADLRLIYLAVAHIIKFRGHFLIEGT-LSSKNNNLQKS--FDHLVDTYNLL--FEEQ-- LLTEGINAK---EL | 211 |
| WP_037581760 | 144 DNPQKADLRLIYLAVAHIIKFRGHFLIEGT-LSSKNNNLQKS--FDHLVDTYNLL--FEEQ-- LLTEGINAK---EL | 211 |
| WP_004232481 | 144 DSPEKVDLRLVYLALAHMIKFRGHFLIEGQ-LNAENTDVQKI--FADFVGVYDRT--FDDS-H LSEITVDAA---SI | 211 |
| WP_009854540 | 145 DSSEKADLRLVYLALAHMIKYRGHFLIEGK-LNAENTDVQKL--FTDFVGVYDRT--FDDS-H LSEITVDVA---ST | 212 |
| WP_012962174 | 145 DSHEKADLRLIYLALAHMIKFRGHFLIEGE-LNAENTDVQKL--FEAFVEVYDRT--FDDS-N LSEITVDAS---SI | 212 |
| WP_039695303 | 145 DSSEKADLRLIYLALAHMIKFRGHFLIEGE-LNAENTDVQKI--FADFVGVYNRT--FDDS-H LSEITVDVA---SI | 212 |
| WP_014334983 | 144 DSQEKADLRLVYLALAHMIKYRGHFLIEGE-LNAENTDVQKL--FNVFVETYDKI--VDES-H LSEIEVDAS---SI | 211 |
| WP_003099269 | 144 DSDQKADLRLIYLALAHIIKFRGHFLIEGN-LDSENTDVHVL--FLNLVNIYNNL--FEED-- VETASIDAE---KI | 211 |
| AHY15608 | 144 DSDQKADLRLIYLALAHIIKFRGHFLIEGN-LDSENTDVHVL--FLNLVNIYNNL--FEED-- VETASIDAE---KI | 211 |
| AHY17476 | 144 DSDQKADLRLIYLALAHIIKFRGHFLIEGN-LDSENTDVHVL--FLNLVNIYNNL--FEED-- VETASIDAE---KI | 211 |
| ESR09100 | ---------------------------------------------------------------- -------------- | |
| AGM98575 | 144 DSDQKADLRLIYLALAHIIKFRGHFLIEGN-LDSENTDVHVL--FLNLVNIYNNL--FEED-- VETASIDAE---KI | 211 |
| ALF27331 | 144 DNPEKTDLRLVYLALAHIIKFRGHFLIEGK-FDTRNNDVQRL--FQEFLAVYDNT--FENS-S LQEQNVQVE---EI | 211 |
| WP_018372492 | 144 DTPDKMDIRLIYLALAHIIKYRGHFLIEGD-LDIENIGIQDS--FKSFIEEYNTQ--FGTK-- -LDSTTKVE---AI | 209 |
| WP_045618028 | 145 DSKEKADFRLIYLALAHIIKYRGHELYEES-FDIKNNDIQKI--FNEFISIYDNT--FEGS-S LNGQNAQVE---AI | 212 |
| WP_045635197 | 144 DSKEKTDLRLIYLALAHMIKYRGHFLYEEA-FDIKNNDIQKI--FNEFISIYDNT--FEGS-S LSGQNAQVE---AI | 211 |
| WP_002263549 | 144 DNPEKVDLRLVYLALAHIIKFRGHFLIEGK-FDTRNNDVQRL--FQEFLAVYDNT--FENS-S LQEQNVQVE---EI | 211 |
| WP_002263887 | 144 DNPEKVDLRLVYLALAHIIKFRGHFLIEGK-FDTRNNDVQRL--FQEFLAVYDNT--FENS-S LQEQNVQVE---EI | 211 |

```
WP_002264920   144 DSTEKADLRLVYLALAHMIKFRGHFLIEGE-LNAENTDVQKL--FADFVGVYDRT--FDDS-H LSEITVDAS---SI 211
WP_002269043   144 DNPEKTDLRLVYLALAHIIKFRGHFLIEGK-FDTRNNDVQRL--FQEFLAVYDNT--FENS-S LQEQNVQVE---EI 211
WP_002269448   144 DNPEKVDLRLVYLALAHIIKFRGHFLIEGK-FDTRNNDVQRL--FQEFLAVYDNT--FENS-S LQEQNVQVE---EI 211
WP_002271977   144 DNPEKVDLRLVYLALAHIIKFRGHFLIEGK-FDTRNNDVQRL--FQEFLAVYDNT--FENS-S LQEQNVQVE---EI 211
WP_002272766   144 DNPEKVDLRLVYLALAHIIKFRGHFLIEGK-FDTRNNDVQRL--FQEFLAVYDNT--FENS-S LQEQNVQVE---EI 211
WP_002273241   144 DNPEKVDLRLVYLALAHIIKFRGHFLIEGK-FDTRNNDVQRL--FQEFLAVYDNT--FENS-S LQEQNVQVE---EI 211
WP_002275430   144 DNPEKVDLRLVYLALAHIIKFRGHFLIEGK-FDTRNNDVQRL--FQEFLAVYDNT--FENS-S LQEQNVQVE---EI 211
WP_002276448   144 DNPEKVDLRLVYLALAHIIKFRGHFLIEGK-FDTRNNDVQRL--FQEFLAVYDNT--FENS-S LQEQNVQVE---EI 211
WP_002277050   144 DSTEKADLRLVYLALAHMIKFRGHFLIEGE-LNAENTDVQKL--FADFVGVYDRT--FDDS-H LSEITVDAS---SI 211
WP_002277364   144 DNPEKVDLRLVYLALAHIIKFRGHFLIEGK-FDTRNNDVQRL--FQEFLAVYDNT--FENS-S LQEQNVQVE---EI 211
WP_002279025   144 DNPEKVDLRLVYLALAHIIKFRGHFLIEGK-FDTRNNDVQRL--FQEFLAVYDNT--FENS-S LQEQNVQVE---EI 211
WP_002279859   144 DSTEKADLRLVYLALAHMIKFRGHFLIEGE-LNAENTDVQKL--FADFVGVYDRT--FDDS-H LSEITVDAS---SI 211
WP_002280230   144 DNPEKVDLRLVYLALAHIIKFRGHFLIEGK-FDTRNNDVQRL--FQEFLAVYDNT--FENS-S LQEQNVQVE---EI 211
WP_002281696   144 DNPEKVDLRLVYLALAHIIKFRGHFLIEGK-FDTRNNDVQRL--FQEFLAVYDNT--FENS-S LQEQNVQVE---EI 211
WP_002282247   144 DSTEKADLRLVYLALAHMIKFRGHFLIEGE-LNAENTDVQKL--FADFVGVYDRT--FDDS-H LSEITVDAS---SI 211
WP_002282906   144 DNPEKVDLRLVYLALAHIIKFRGHFLIEGK-FDTRNNDVQRL--FQEFLAVYDNT--FENS-S LQEQNVQVE---EI 211
WP_002283846   144 DNPEKTDLRLVYLALAHIIKFRGHFLIEGK-FDTRNNDVQRL--FQEFLAVYDNT--FENS-S LQEQNVQVE---EI 211
WP_002287255   144 DNPEKVDLRLVYLALAHIIKFRGHFLIEGK-FDTRNNDVQRL--FQEFLAVYDNT--FENS-S LQEQNVQVE---EI 211
WP_002288990   144 DNPEKTDLRLVYLALAHIIKFRGHFLIEGK-FDTRNNDVQRL--FQEFLAVYDNT--FENS-S LQEQNVQVE---EI 211
WP_002289641   144 DNPEKTDLRLVYLALAHIIKFRGHFLIEGK-FDTRNNDVQRL--FQEFLAVYDNT--FENS-S LQEQNVQVE---EI 211
WP_002290427   144 DNPEKTDLRLVYLALAHIIKFRGHFLIEGK-FDTRNNDVQRL--FQEFLAVYDNT--FENS-S LQEQNVQVE---EI 211
WP_002295753   144 DNPEKVDLRLVYLALAHIIKERGHFLIEGK-FDTRNNDVQRL--FQEFLAVYDNT--FENS-S LQEQNVQVE---EI 211
WP_002296423   144 DNPEKTDLRLVYLALAHIIKFGGHFLIEGK-FDTRNNDVQRL--FQEFLAVYDNT--FENS-S LQEQNVQVE---EI 211
WP_002304487   144 NSTEKADLRLVYLSLAHMIKFRGHFLIEGQ-LKAENTNVQAL--FKDFVEVYDKT--VEES-H LSEMTVDAL---SI 211
WP_002305844   144 DNPEKVDLRLVYLALAHIIKFRGHFLIEGK-FDTRNNDVQRL--FQEFLAVYDNT--FENS-S LQEQNVQVE---EI 211
WP_002307203   144 DNPEKVDLRLVYLALAHIIKFRGHFLIEGK-FDTRNNDVQKL--FQEFLAVYDNI--FENS-S LQEQNVQVE---EI 211
WP_002310390   144 DNPEKTDLRLVYLALAHIIKFRGHFLIEGK-FDTRNNDVQRL--FQEFLAVYDNT--FENS-S LQEQNVQVE---EI 211
WP_002352408   144 DNPEKTDLRLVYLALAHIIKFRGHFLIEGK-FDTRNNDVQRL--FQEFLAVYDNT--FENS-S LQEQNVQVE---EI 211
WP_012997688   144 DNPEKVDLRLVYLALAHIIKFRGHFLIEGK-FDTRNNDVQRL--FQEFLAVYDNT--FENS-S LQEQNVQVE---EI 211
WP_014677909   144 DNPEKTDLRLVYLALAHIIKFRGHFLIEGK-FDTRNNDVQRL--FQEFLAVYDNT--FENS-S LQEQNVQVE---EI 211
WP_019312892   144 DNPEKVDLRLVYLALAHIIKFRGHFLIEGK-FDTRNNDVQRL--FQEFLAVYDNT--FENS-S LQEQNVQVE---EI 211
WP_019313659   144 DNPEKVDLRLVYLALAHIIKFRGHFLIEGK-FDTRNNDVQRL--FQEFLAVYDNT--FENS-S LQEQNVQVE---EI 211
WP_019314093   144 DNPEKVDLRLVYLALAHIIKFRGHFLIEGK-FDTRNNDVQKL--FQEFLAVYDNT--FENS-S LQEQNVQVE---EI 211
WP_019315370   144 DNPEKTDLRLVYLALAHIIKFRGHFLIEGK-FDTRNNDVQRL--FQEFLAVYDNT--FENS-S LQEQNVQVE---EI 211
WP_019803776   144 DNPEKVDLRLVYLALAHIIKFRGHFLIEGK-FDTRNNDVQRL--FQEFLAVYDNT--FENS-S LQEQNVQVE---EI 211
WP_019805234   144 DNPEKTDLRLVYLALAHIIKFRGHFLIEGK-FDTRNNDVQRL--FQEFLAVYDNT--FENS-S LQEQNVQVE---EI 211
WP_024783594   144 DNPEKVDLRLVYLALAHIIKFRGHFLIEGK-FDTRNNDVQRL--FQEFLAVYDNT--FENS-S LQEQNVQVE---EI 211
WP_024784288   144 DSTEKADLRLVYLALAHMIKFRGHFLIEGE-LNAENTDVQKL--FADFVGVYDRT--FDDS-H LSEITVDAS---SI 211
WP_024784666   144 DNPEKVDLRLVYLALAHIIKFRGHFLIEGK-FDTRNNDVQRL--FQEFLAVYDNT--FENS-S LQEQNVQVE---EI 211
WP_024784894   144 DNPEKTDLRLVYLALAHIIKFRGHFLIEGK-FDTRNNDVQRL--FQEFLAVYDNT--FENS-S LQEQNVQVE---EI 211
WP_024786433   144 DSTEKADLRLVYLALAHMIKFRGHFLIEGE-LNAENTDVQKL--FADFVGVYDRT--FDDS-H LSEITVDAS---SI 211
```

```
WP_049473442  144  DNPEKVDLRLVYLALAHIIKERGHFLIEGK-FDTRNNDVQRL--FQEFLAVYDNI--FENS-S LQEQNVQVE---EI  211
WP_049474547  144  DNPEKTDLRLVYLALAHIIKFRGHFLIEGK-FDTRNNDVQRL--FQEFLAVYDNT--FENS-S LQEQNVQVE---EI  211
EMC03581      137  DNPEKVDLRLVYLALAHIIKFRGHFLIEGK-FDTRNNDVQRL--FQEFLAVYDNT--FENS-S LQEQNVQVE---EI  204
WP_000428612  145  DSKEKTDLRLIYLALAHMIKYRGHFLYEDT-FDIKNNDIQKI--FNEFISIYNNT--FEGN-S LSGQNVQVE---AI  212
WP_000428613  145  DSKEKTDLRLIYLALAHMIKYRGHFLYEDT-FDIKNNDIQKI--FSEFISIYDNT--FEGS-S LSGQNAQVE---AI  212
WP_049523028  144  DSKEKVDLRLIYLALAHIIKYRGHFLYEDS-FDIKNNDIQKI--FNEFTILYDNT--FEES-S LSKGNAQVE---EI  211
WP_003107102  113  DSDEKADLRLIYLALAHIIKFRGHFLIEGD-LDSQNTDVNAL--FLKLVDTYNLM--FEDD-- IDTQTIDAT---VI  180
WP_054279288  146  DNTEKADLRLIYLALAHIIKFRGHFLIEGA-LSANNTDVQQL--VHALVDAYNIM--FEED-- LDIEAIDVK---AI  213
WP_049531101  145  DSKEKADLRLIYLTLAHMIKYRGHFLYEES-FDIKNNDIQKI--FNEFISIYDNT--FEGS-S LSGQNAQVE---AI  212
WP_049538452  145  DSKEKADLRLIYLALAHMIKYRGHFLYEEA-FDIKNNDIQKI--FNEFINIYDNT--FEGS-S LSGQNEQVE---AI  212
WP_049549711  145  DSKEKADLRLIYLVLAHMIKYRGHFLYEEA-FDTRNNDIQKI--FNEFISIYDNT--FEGS-S LSGQNAQVE---TI  212
WP_007896501  146  DRDQKADLRLIYLALSHIIKFRGHFLIEGK-LNSENTDVQKL--FIALVTVYNLL--FEEE-- IAGETCDAK---AL  213
EFR44625       98  DRDQKADLRLIYLALSHIIKFRGHFLIEGK-LNSENTDVQKL--FIALVTVYNLL--FEEE-- IAGETCDAK---AL  165
WP_002897477  144  DSKEKSDVRLIYLALAHMIKYRGHFLYEET-FDIKNNDIQKI--FNEFINIYDNT--FEGS-S LSGQNAQVE---AI  211
WP_002906454  144  DSKEKTDLRLIYLALAHMIKYRGHFLYEES-FDIKNNDIQKI--FNEFISIYDNT--FEGS-S LSGQNAQVE---AI  211
WP_009729476  145  DSKEKTDLRLIYLALAHMIKYRGHFLYEEA-FDIKNNDIQKI--FNEFISIYNNT--FEGN-S LSGQNVQVE---AI  212
CQR24647      144  DSSEKADLRLVYLALAHIIKYRGHFLIDEP-IDIRNMNSQNL--FKEFLLAFDGI--QVDC-Y LASKHTDIS---GI  211
WP_000066813  145  DSKEKTDLRLIYLALAHMIKYRGHFLYEES-FDIKNNDIQKI--FSEFISIYDNT--FEGK-S LSGQNAQVE---AI  212
WP_009754323  145  DSKEKADLRLIYLALAHITKYRGHFLYEEA-FDIKNNDIQKI--FNEFINIYDNT--FEGS-S LSGQNAQVE---AI  212
WP_044674937  144  DSSQKADIRLIYLALAHIIKYRGHFLFEGD-LKSENKDVQHL--FNDFVEMEDKT--VEGS-Y LSENLPNVA---DV  211
WP_044676715  144  DSSQKADIRLIYLALAHIIKYRGHELFEGD-LKSENKDVQHL--FNDFVEMEDKT--VEGS-Y LSENLPNVA---DV  211
WP_044680361  144  DSSQKADIRLIYLALAHIIKYRGHELFEGD-LKSENKDVQHL--FNDFVEMEDKT--VEGS-Y LSENLPNVA---DV  211
WP_044681799  144  DSSQKADIRLIYLALAHIIKYRGHELFEGD-LKSENKDVQHL--FNDFVEMEDKT--VEGS-Y LSENLPNVA---DV  211
WP_049533112  144  DISQKADLRLVYLALAHMIKFRGHFLIEGQ-LKAENTNVQAL--FKDFVEVYDKT--VEES-H LSEMTVDAL---SI  211
WP_029090905  101  SQHRQFDIREVYLAIHHLIKYRGHFIYEDQtFTTDGNQLQHH--IKAIITMINSTl---NR-- IIPETIDINvfeKI  171
WP_006506696  140  ESTEKADPRLIYLALHHIVKYRGNFLYEGQkFNMDASNIEDK--LSDIFTQFTSFnnIPYEdD --KKNLEIL---EI  210
AIT42264      144  DSTDKADLRLIYLALAHMIKFRGHFLIEGD-LNPDNSDVDKL--FIQLVQTYNQL--FEEN-- INASGVDAK---AI  211
WP_034440723  143  DSNQKADLRLIYLALAHMIKYRGHFLIEGD-LKMDGISISES--FQEFIDSYNEVcaLEDE-N NDELLTQIE---NI  217
AKQ21048      144  DSTDKADLRLIYLALAHMIKFRGHFLIEGD-LNPDNSDVDKL--FIQLVQTYNQL--FEEN-- INASGVDAK---AI  211
WP_004636532  144  DNPEKADLRLVYTALAHIVKYRGHFLIEGE-LNTENTSISET--FEQFLDTYSDI--FKEQ-- LVGDISKVE---EI  210
WP_002364836  144  DSSEQADLRLIYLALAHIVKYRGHFLIEGK-LSTENISVKEQ--FQQFMIIYNQT--FVNGeS PLPESVLIE---EE  217
WP_016631044   95  DSSEQADLRLIYLALAHIVKYRGHFLIEGK-LSTENTSVKDQ--FQQFMVIYNQT--FVNGeS PLPESVLIE---EE  168
EMS75795           ----------------------------------------------------------- --------------
WP_002373311  144  DSSEQADLRLIYLALAHIVKYRGHFLIEGK-LSTENTSVKEQ--FQQFMVIYNQT--FVNGeS PLPESVLIE---EE  217
WP_002378009  144  DSSEQADLRLIYLALAHIVKYRGHFLIEGK-LSTENISVKEQ--FQQFMIIYNQT--FVNGeS PLPESVLIE---EE  217
WP_002407324  144  DSSEQADLRLIYLALAHIVKYRGHFLIEGK-LSTENISVKEQ--FQQFMIIYNQT--FVNGeS PLPESVLIE---EE  217
WP_002413717  144  DSSEQADLRLIYLALAHIVKYRGHFLIEGK-LSTENISVKEQ--FQQFMIIYNQT--FVNGeS PLPESVLIE---EE  217
WP_010775580  144  DSSEQADLRLIYLALAHIVKYRGHFLIEGK-LSTENISVKEQ--FQQFMIIYNQT--FVNGeS PLPESVLIE---EE  217
WP_010818269  144  DSSEQADLRLIYLALAHIVKYRGHFLIEGK-LSTENISVKEQ--FQQFMIIYNQT--FVNGeS PLPESVLIE---EE  217
WP_010824395  144  DSSEQADLRLIYLALAHIVKYRGHFLIEGK-LSTENTSVKDQ--FQQFMVIYNQT--FVNGeS PLPESVLIE---EE  217
```

```
                    -continued
WP_016622645  144 DSSEQADLRLIYLALAHIVKYRGHFLIEGK-LSTENISVKEK--FQQFMIIYNQT--FVNGeG PLPESVLIE---EE  217
WP_033624816  144 DSSEQADLRLIYLALAHIVKYRGHFLIEGK-LSTENISVKDQ--FQQFMVIYNQT--FVNGeS PLPESVLIE---EE  217
WP_033625576  144 DSSEQADLRLIYLALAHIVKYRGHFLIEGK-LSTENISVKEQ--FQQFMIIYNQT--FVNGeS PLPESVLIE---EE  217
WP_033789179  144 DSSEQADLRLIYLALAHIVKYRGHFLIEGK-LSTENISVKEQ--FQQFMIIYNQT--FVNGeS PLPESVLIE---EE  217
WP_002310644  144 DSSEKADIRLVYLAMAHLLKYRGHFLIEGE-LNTENSSVTET--FRQFLSTYNQQ--FSEA-D KLDEAVDCS---FV  216
WP_002312694  144 DSSEKADIRLVYLAMAHLLKYRGHFLIEGE-LNTENSSVTET--FRQFLSTYNQQ--FSEA-G KLDEAVDCS---FV  216
WP_002314015  144 DSSEKADIRLVYLAMAHLLKYRGHFLIEGE-LNTENSSVTET--FRQFLSTYNQQ--FSEA-D KLDEAVDCS---FV  216
WP_002320716  144 DSSEKADIRLVYLAMAHLLKYRGHFLIEGE-LNTENSSVTET--FRQFLSTYNQQ--FSEA-D KLDEAVDCS---FV  216
WP_002330729  144 DSSEKADIRLVYLAMAHLLKYRGHFLIEGE-LNTENSSVTET--FRQFLSTYNQQ--FSEA-D KLDEAVDCS---FV  216
WP_002335161  144 DSSEKADIRLVYLAMAHLLKYRGHFLIEGE-LNTENSSVTET--FRQFLSTYNQQ--FSEA-D KLDEAVDCS---FV  216
WP_002345439  144 DSSEKADIRLVYLAMAHLLKYRGHFLIEGE-LNTENSSVTET--FRQFLSTYNQQ--FSEA-D KLDEAVDCS---FV  216
WP_034867970  144 DSTEKEDLRLVYLALAHLLKYRGHELFEGD-LDTENTSIEES--FRVFLEQYSKQ--SDQP-- -LIVHQPVL---TI  209
WP_047937432  144 DSSEKADLRLVYLAMAHLLKYRGHFLIEGE-LNTENSSVTET--FRQFLSTYNQQ--FSEA-D KLDEAVDCS---FV  216
WP_010720994  144 DSTEKGDLRLVYLALAHLLKYRGHFLFEGD-LDTENTSIEES--FRVFLEQYGKQ--SDQP-- -LIVHQPVL---TI  209
WP_010737004  144 DSTEKEDLRLVYLALAHLLKYRGHELFEGD-LDTENTSIEES--FRVFLEQYSKQ--SDQP-- -LIVHQPVL---TI  209
WP_034700478  144 DSTEKEDLRLVYLALAHLLKYRGHELFEGD-LDTENTSIEES--FRVFLEQYGKQ--SDQP-- -LIVHQPVL---TI  209
WP_007209003  144 DGDEKADLRLVYLAIAHIIKFRGNFLIEGE-LNTENNSVIELs--KVFVQLYNQTl-SELE-- FIDESIDES---EV  214
WP_023519017  144 NSKEQADIRLVYLAIAHCLKYRGHFLFEGE-LDTENTSVTEN--YQQFLQAYQQF--FPEP-- -IGDLDDAV---PI  209
WP_010770040  144 DTSEQADLRLVYLALAHIVKYRGHFLIEGE-LNTENSSVSET--FRTFIQVYNQI--FRENe- PLAVPDNIE---EL  212
WP_048604708  144 DAEEKADLRLVYLALAHIIKYRGHFLIEGR-LSTENTSTEET--FKTFLQKYNQT--FN---- PVDETISIG---SI  208
WP_010750235  144 DSTEKADIRLVYLALAHMIKYRGHFLFEGE-LDTENTSVEET--FKEFIDIYNEQ--FEEG-- IIFYKDIP---LI   209
AII16583      183 DSTDKADLRLIYLALAHMIKFRGHFLIEGD-LNPDNSDVDKL--FIQLVQTYNQL--FEEN-- INASGVDAK---AI  250
WP_029073316  145 ESKEKEDPRLIYLALHHIVKYRGNFLYEGQkFSMDVSNIEDK--MIDVLRQFNEInlFEYVeD --KKIDEVL---NV  215
WP_031589969  145 ESKEKEDPRLIYLALHHIVKYRGNFLYEGQkFSMDVSNIEDK--MIDVLRQFNEInlFEYVeD --KKIDEVL---NV  215
KDA45870      145 NNDRPADLRLVYLALAHIIKYRGNFLLEGE-IDLRTTDINKV--FAEFSETLNEN--SDEN1G ----KLDVA---DI  209
WP_039099354  133 TEKRQFDIREIYLAMHHIVKYRGHFLNEAPvSSFKSSEINLVahFDRLNTIFADL--FSESgF -TDKLAEVK---AL  206
AKP02966      138 INKNKADIRLVYLALHNILKYRGNFTYEHQkFNISTLNSNLS---KELIELNQQLikYDIS-- -FPDNCDWNhisDI 208
WP_010991369  144 NSSEKADLRLVYLALAHIIKYRGNFLIEGA-LDTQNTSVDGI--YKQFIQTYNQV--FASGiE KLEDNKDVA---KI  217
WP_033838504  144 NSSEKADLRLVYLALAHIIKYRGNFLIEGA-LDTQNTSVDGI--YKQFIQTYNQV--FASGiE KLEDNKDVA---KI  217
EHN60060      147 NSSEKADLRLVYLALAHIIKYRGNFLIEGA-LDTQNTSVDGI--YKQFIQTYNQV--FASGiE KLEDNKDVA---KI  220
EFR89594          -----------------------------------------------------------------  --------------
WP_038409211  144 NSSDKADLRLVYLALAHIIKYRGNFLIEGM-LDTKNTSVDEV--FKQFIQTYNQI--FASDiE RLEENKEVA---EI  217
EFR95520          -----------------------------------------------------------------  --------------
WP_003723650  144 NSSEKADLRLVYLALAHIIKYRGNFLIEGA-LDTKNTSVDEV--YKQFIETYNQV--FMSNiE KVEENIEVA---NI  217
WP_003727705  144 NSSEKADLRLVYLALAHIIKYRGNFLIEGA-LDTKNTSVDEV--YKQFIQTYNQV--FMSNiE KVEENTEVA---SI  217
WP_003730785  144 NSSEKADLRLVYLALAHIIKYRGNFLIEGA-LDTKNTSVDEV--YKQFIQTYNQV--FMSNiE KVEENTEVA---SI  217
WP_003733029  144 DSQKKADLRLVYLALAHIIKYRGHFLIEGA-LDTKNTSIDEM--FKQFLQIYNQV--FANDiE KTEKNQEVA---QI  217
WP_003739838  144 NSSEKADLRLVYLALAHIIKYRGNFLIEGA-LDTKNTSVDGV--YKQFIQTYNQV--FISNiE KMEENTTVA---DI  217
WP_014601172  144 NSSEKADLRLVYLALAHIIKYRGNFLIEGA-LDTKNTSVDGV--YEQFIQTYNQV--FMSNiE KVEENIEVA---NI  217
WP_023548323  144 NSSEKADLRLVYLALAHIIKYRGNFLIEGA-LDTKNTSVDGV--YEQFILTYNQV--FMSNiE KVEENIEVA---NI  217
WP_031665337  144 NSSEKADLRLVYLALAHIIKYRGNFLIEGA-LDTKNTSVDGV--YEQFIQTYNQV--FMSNiE KVEENIEVA---NI  217
```

```
WP_031669209    144 DSQKKADLRLVYLALAHIIKYRGHFLIEGA-LDTKNTSIDEM--FKQFLQIYNQV--FANDiE KTEKNQEVA---QI  217
WP_033920898    144 NSSEKADLRLVYLALAHIIKYRGNFLIEGA-LDTKNTSVDGV--YEQFIQTYNQV--FMSNiE KVEENIEVA---NI  217
AKI42028        147 NSSEKADLRLVYLALAHIIKYRGNFLIEGA-LDTKNTSVDGV--YEQFIQTYNQV--FMSNiE KVEENIEVA---NI  220
AKI50529        147 NSSEKADLRLVYLALAHIIKYRGNFLIEGA-LDTKNTSVDGV--YEQFIQTYNQV--FMSNiE KVEENIEVA---NI  220
EFR83390            ---------------------------------------------------------- --------------
WP_046323366    144 NSSDKADLRLVYLALAHIIKYRGNFLIEGK-LDTKNTSVDEV--FKQFIKTYNQV--FASDiE RIEENNEVA---KI  217
AKE81011        160 DSTDKADLRLIYLALAHMIKFRGHFLIEGD-LNPDNSDVDKL--FIQLVQTYNQL--FEEN-- INASGVDAK---AI  227
CUO82355        144 ESTEKADPRLYLALHHIVKYRGNFLYEGQkFNMDASNIEDK--LSDVFTQFADEnnIPYEdD --KKNLEIL---EI  214
WP_033162887    145 ENKEKADPRLIYLALHHIVKYRGNFLYEGQsFTMDNSDIEER--LNSAIEKFMSIneFDNRiV --SDINSMI---AV  215
AGZ01981        177 DSTDKADLRLIYLALAHMIKFRGHFLIEGD-LNPDNSDVDKL--FIQLVQTYNQL--FEEN-- INASGVDAK---AI  244
AKA60242        144 DSTDKADLRLIYLALAHMIKFRGHFLIEGD-LNPDNSDVDKL--FIQLVQTYNQL--FEEN-- INASGVDAK---AI  211
AKS40380        144 DSTDKADLRLIYLALAHMIKFRGHFLIEGD-LNPDNSDVDKL--FIQLVQTYNQL--FEEN-- INASGVDAK---AI  211
4UN5_B          148 DSTDKADLRLIYLALAHMIKFRGHFLIEGD-LNPDNSDVDKL--FIQLVQTYNQL--FEEN-- INASGVDAK---AI  215
WP_010922251    212 LSAR-LSKSRRLENLIAQ-L-PG EKKNGLFGNLIALSLGLTPNFKSNF--DLAED-A---KLQ--LSKDTYDDDLDN  277
WP_039695303    213 LTEK-ISKSRRLENLIKY-Y-PT EKKNTLFGNLIALALGLQPNFKTNF--KLSED-A---KLQ--FSKDTYEEDLEE  278
WP_045635197    212 FTDK-ISKSAKRERVLKL-F-PD EKSTGLFSEFLKLIVGNQADFKKHF--DLEDK-A---PLQ--FSKDTYDEDLEN  277
5AXW_A          135 LSTK--------EQISRN-S--K ----------------------------LEEKyVa--ELQ--------------  157
WP_009880683        ---------------------- ----------------------------------------------------
WP_010922251    212 LSAR-LSKSRRLENLIAQ-L-PG EKKNGLFGNLIALSLGLTPNFKSNF--DLAED-A---KLQ--LSKDTYDDDLDN  277
WP_011054416    212 LSAR-LSKSRRLENLIAQ-L-PG EKKNGLFGNLIALSLGLTPNFKSNF--DLAED-A---KLQ--LSKDTYDDDLDN  277
WP_011284745    212 LSAR-LSKSRRLENLIAQ-L-PG EKKNGLFGNLIALSLGLTPNFKSNF--DLAED-A---KLQ--LSKDTYDDDLDN  277
WP_011285506    212 LSAR-LSKSRRLENLIAQ-L-PG EKKNGLFGNLIALSLGLTPNFKSNF--DLAED-A---KLQ--LSKDTYDDDLDN  277
WP_011527619    212 LSAR-LSKSRRLENLIAQ-L-PG EKKNGLFGNLIALSLGLTPNFKSNF--DLAED-A---KLQ--LSKDTYDDDLDN  277
WP_012560673    212 LSAR-LSKSRRLENLIAQ-L-PG EKRNGLFGNLIALSLGLTPNFKSNF--DLAED-A---KLQ--LSKDTYDDDLDN  277
WP_014407541    212 LSAR-LSKSRRLENLIAQ-L-PG EKRNGLFGNLIALSLGLTPNFKSNF--DLAED-A---KLQ--LSKDTYDDDLDN  277
WP_020905136    212 LSAR-LSKSRRLENLIAQ-L-PG EKKNGLFGNLIALSLGLTPNFKSNF--DLAED-A---KLQ--LSKDTYDDDLDN  277
WP_023080005    212 LSAR-LSKSRRLENLIAQ-L-PG EKKNGLFGNLIALSLGLTPNFKSNF--DLAED-A---KLQ--LSKDTYDDDLDN  277
WP_023610282    212 LSAR-LSKSRRLENLIAQ-L-PG EKKNGLFGNLIALSLGLTPNFKSNF--DLAED-A---KLQ--LSKDTYDDDLDN  277
WP_030125963    212 LSAR-LSKSRRLENLIAQ-L-PG EKKNGLFGNLIALSLGLTPNFKSNF--DLAED-A---KLQ--LSKDTYDDDLDN  277
WP_030126706    212 LSAR-LSKSRRLENLIAQ-L-PG EKKNGLFGNLIALSLGLTPNFKSNF--DLAED-A---KLQ--LSKDTYDDDLDN  277
WP_031488318    212 LSAR-LSKSRRLENLIAQ-L-PG EKRNGLFGNLIALSLGLTPNFKSNF--DLAED-A---KLQ--LSKDTYDDDLDN  277
WP_032460140    212 LSAR-LSKSRRLENLIAQ-L-PG EKRNGLFGNLIALSLGLTPNFKSNF--DLAED-A---KLQ--LSKDTYDDDLDN  277
WP_032461047    212 LSAR-LSKSRRLENLIAQ-L-PG EKRNGLFGNLIALSLGLTPNFKSNF--DLAED-A---KLQ--LSKDTYDDDLDN  277
WP_032462016    212 LSAR-LSKSRRLENLIAQ-L-PG EKKNGLFGNLIALSLGLTPNFKSNF--DLAED-A---KLQ--LSKDTYDDDLDN  277
WP_032462936    212 LSAR-LSKSRRLENLIAQ-L-PG EKKNGLFGNLIALLLGLTPNFKSNF--DLAED-A---KLQ--LSKDTYDDDLDN  277
WP_032464890    212 LSAR-LSKSRRLENLIAQ-L-PG EKKNGLFGNLIALSLGLTPNFKSNF--DLAED-A---KLQ--LSKDTYDDDLDN  277
WP_033888930     37 LSAR-LSKSRRLENLIAQ-L-PG EKKNGLFGNLIALSLGLTPNFKSNF--DLAED-A---KLQ--LSKDTYDDDLDN  102
WP_038431314    212 LSAR-LSKSRRLENLIAQ-L-PG EKKNGLFGNLIALSLGLTPNFKSNF--DLAED-A---KLQ--LSKDTYDDDLDN  277
WP_038432938    212 LSAR-LSKSRRLENLIAQ-L-PG EKKNGLFGNLIALSLGLTPNFKSNF--DLAED-T---KLQ--LSKDTYDDDLDN  277
WP_038434062    212 LSAR-LSKSRRLENLIAQ-L-PG EKRNGLFGNLIALSLGLTPNFKSNF--DLAED-A---KLQ--LSKDTYDDDLDN  277
```

```
BAQ51233          123 LSAR-LSKSRRLENLIAQ-L-PG EKKNGLFGNLIALSLGLTPNFKSNF--DLAED-A---KLQ--LSKDTYDDDLDN 188
KGE60162              ---------------------- --------------------------------------------------- 277
KGE60856              ---------------------- ---------------------------------------------------
WP_002989955      212 LSAR-LSKSRRLENLIAQ-L-PG EKKNGLFGNLIALSLGLTPNFKSNF--DLAED-A---KLQ--LSKDTYDDDLDN 277
WP_003030002      212 LTEK-VSKSRRLENLIAH-Y-PA EKKNTLFGNLIALSLGLQPNFKINF--QLSED-A---KLQ--FSKDTYEEDLEG 277
WP_003065552      215 LTEK-ISKSRRLENLIKY-Y-PT EKKNTLFGNLIALALGLQPNFKMNF--KLSED-A---KLQ--FSKDSYEEDLGE 280
WP_001040076      213 LTDK-ISKSAKKDRILAQ-Y-PN QKSTGIFAEFLKLIVGNQADFKKHF--NLEDK-T---PLQ--FAKDSYDEDLEN 278
WP_001040078      213 LTDK-ISKSAKKDRILAQ-Y-PN QKSTGIFAEFLKLIVGNQADFKKHF--NLEDK-T---PLQ--FAKDSYDEDLEN 278
WP_001040080      213 LTDK-ISKSAKKDRILAQ-Y-PN QKSTGIFAEFLKLIVGNQADFKKYF--NLEDK-T---PLQ--FAKDSYDEDLEN 278
WP_001040081      213 LTDK-ISKSAKKDRILAQ-Y-PN QKSTGIFAEFLKLIVGNQADFKKYF--NLEDK-T---PLQ--FAKDSYDEDLEN 278
WP_001040083      213 LTDK-ISKSAKKDRILAQ-Y-PN QKSTGIFAEFLKLIVGNQADFKKYF--NLEDK-T---PLQ--FAKDSYDEDLEN 278
WP_001040085      213 LTDK-ISKSAKKDRILAQ-Y-PN QKSTGIFAEFLKLIVGNQADFKKYF--NLEDK-T---PLQ--FAKDSYDEDLEN 278
WP_001040087      213 LTDK-ISKSAKKDRILAQ-Y-PN QKSTGIFAEFLKLIVGNQADFKKYF--NLEDK-T---PLQ--FAKDSYDEDLEN 278
WP_001040088      213 LTDK-ISKSAKKDRILAQ-Y-PN QKSTGIFAEFLKLIVGNQADFKKYF--NLEDK-T---PLQ--FAKDSYDEDLEN 278
WP_001040089      213 LTDK-ISKSAKKDRILAQ-Y-PN QKSTGIFAEFLKLIVGNQADFKKYF--NLEDK-T---PLQ--FAKDSYDEDLEN 278
WP_001040090      213 LTDK-ISKSAKKDRILAQ-Y-PN QKSTGIFAEFLKLIVGNQADFKKYF--NLEDK-T---PLQ--FAKDSYDEDLEN 278
WP_001040091      213 LTDK-ISKSAKKDRILAQ-Y-PN QKSTGIFAEFLKLIVGNQADFKKYF--NLEDK-T---PLQ--FAKDSYDEDLEN 278
WP_001040092      213 LTDK-ISKSAKKDRILAQ-Y-PN QKSTGIFAEFLKLIVGNQADFKKHF--NLEDK-T---PLQ--FAKDSYDEDLEN 278
WP_001040094      213 LTDK-ISKSAKKDRILAR-Y-PN QKSTGIFAEFLKLIVGNQADFKKHF--NLEDK-T---PLQ--FAKDSYDEDLEN 278
WP_001040095      213 LTDK-ISKSAKKDRILAR-Y-PN QKSTGIFAEFLKLIVGNQADFKKHF--NLEDK-T---PLQ--FAKDSYDEDLEN 278
WP_001040096      213 LTDK-ISKSAKKDRILAR-Y-PN QKSTGIFAEFLKLIVGNQADFKKHF--NLEDK-T---PLQ--FAKDSYDEDLEN 278
WP_001040097      213 LTDK-ISKSAKKDRILAR-Y-PN QKSTGIFAEFLKLIVGNQADFKKHF--NLEDK-T---PLQ--FAKDSYDEDLEN 278
WP_001040098      213 LTDK-ISKSAKKDRILAR-Y-PN QKSTGIFAEFLKLIVGNQADFKKHF--NLEDK-T---PLQ--FAKDSYDEDLEN 278
WP_001040099      213 LTDK-ISKSAKKDRILAR-Y-PN QKSTGIFAEFLKLIVGNQADFKKHF--NLEDK-T---PLQ--FAKDSYDEDLEN 278
WP_001040100      213 LTDK-ISKSAKKDRILAR-Y-PN QKSTGIFAEFLKLIVGNQADFKKHF--NLEDK-T---PLQ--FAKDSYDEDLEN 278
WP_001040104      213 LTDK-ISKSAKKDRILAQ-Y-PN QKSTGIFAEFLKLIVGNQADFKKYF--NLEDK-T---PLQ--FAKDSYDEDLEN 278
WP_001040105      213 LTDK-ISKSAKKDRILAQ-Y-PN QKSTGIFAEFLKLIVGNQADFKKYF--NLEDK-T---PLQ--FAKDSYDEDLEN 278
WP_001040106      213 LTDK-ISKSAKKDRILAQ-Y-PN QKSTGIFAEFLKLIVGNQADFKKHF--NLEDK-T---PLQ--FAKDSYDEDLEN 278
WP_001040107      213 LTDK-ISKSAKKDRILAQ-Y-PN QKSTGIFAEFLKLIVGNQADFKKHF--NLEDK-T---PLQ--FAKDSYDEDLEN 278
WP_001040108      213 LTDK-ISKSAKKDRILAQ-Y-PN QKSTGIFAEFLKLIVGNQADFKKHF--NLEDK-T---PLQ--FAKDSYDEDLEN 278
WP_001040109      213 LTDK-ISKSAKKDRILAQ-Y-PN QKSTGIFAEFLKLIVGNQADFKKHF--NLEDK-T---PLQ--FAKDSYDEDLEN 278
WP_001040110      213 LTDK-ISKSAKKDRILAQ-Y-PN QKSTGIFAEFLKLIVGNQADFKKHF--NLEDK-T---PLQ--FAKDSYDEDLEN 278
WP_015058523      213 LTDK-ISKSAKKDRILAQ-Y-PN QKSTGIFAEFLKLIVGNQADFKKHF--NLEDK-T---PLQ--FAKDSYDEDLEN 278
WP_017643650      213 LTDK-ISKSAKKDRILAR-Y-PN QKSTGIFAEFLKLIVGNQADFKKHF--NLEDK-T---PLQ--FAKDSYDEDLEN 278
WP_017647151      213 LTDK-ISKSAKKDRILAQ-Y-PN QKSTGIFAEFLKLIVGNQADFKKHF--NLEDK-T---PLQ--FAKDSYDEDLEN 278
WP_017648376      213 LTDK-ISKSAKKDRILAQ-Y-PN QKSTGIFAEFLKLIVGNQADFKKHF--NLEDK-T---PLQ--FAKDSYDEDLEN 278
WP_017649527      213 LTDK-ISKSAKKDRILAQ-Y-PN QKSTGIFAEFLKLIVGNQADFKKYF--NLEDK-T---PLQ--FAKDSYDEDLEN 278
WP_017771611      213 LTDK-ISKSAKKDRILAQ-Y-PN QKSTGIFAEFLKLIVGNQADFKKHF--NLEDK-T---PLQ--FAKDSYDEDLEN 278
WP_017771984      213 LTDK-ISKSAKKDRILAQ-Y-PN QKSTGIFAEFLKLIVGNQADFKKYF--NLEDK-T---PLQ--FAKDSYDEDLEN 278
CFQ25032          213 LTDK-ISKSAKKDRILAQ-Y-PN QKSTGIFAEFLKLIVGNQADFKKYF--NLEDK-T---PLQ--FAKDSYDEDLEN 278
```

-continued

```
CFV16040        213 LTDK-ISKSAKKDRILAQ-Y-PN QKSTGIFAEFLKLIVGNQADFKKYF--NLEDK-T---PLQ--FAKDSYDEDLEN 278
KLJ37842        213 LTDK-ISKSAKKDRILAQ-Y-PN QKSTGIFAEFLKLIVGNQADFKKYF--NLEDK-T---PLQ--FAKDSYDEDLEN 278
KLJ72361        213 LTDK-ISKSAKKDRILAQ-Y-PN QKSTGIFAEFLKLIVGNQADFKKYF--NLEDK-T---PLQ--FAKDSYDEDLEN 278
KLL20707        213 LTDK-ISKSAKKDRILAQ-Y-PN QKSTGIFAEFLKLIVGNQADFKKYF--NLEDK-T---PLQ--FAKDSYDEDLEN 278
KLL42645        213 LTDK-ISKSAKKDRILAQ-Y-PN QKSTGIFAEFLKLIVGNQADFKKHF--NLEDK-T---PLQ--FAKDSYDEDLEN 278
WP_047207273    213 LTDK-ISKSAKKDRILAQ-Y-PN QKSTGIFAEFLKLIVGNQADFKKYF--NLEDK-T---PLQ--FAKDSYDEDLEN 278
WP_047209694    213 LTDK-ISKSAKKDRILAR-Y-PN QKSTGIFAEFLKLIVGNQADFKKHF--NLEDK-T---PLQ--FAKDSYDEDLEN 278
WP_050198062    213 LTDK-ISKSAKKDRILAQ-Y-PN QKSTGIFAEFLKLIVGNQADFKKYF--NLEDK-T---PLQ--FAKDSYDEDLEN 278
WP_050201642    213 LTDK-ISKSAKKDRILAQ-Y-PN QKSTGIFAEFLKLIVGNQADFKKYF--NLEDK-T---PLQ--FAKDSYDEDLEN 278
WP_050204027    213 LTDK-ISKSAKKDRILAQ-Y-PN QKSTGIFAEFLKLIVGNQADFKKHF--NLEDK-T---PLQ--FAKDSYDEDLEN 278
WP_050881965    213 LTDK-ISKSAKKDRILAQ-Y-PN QKSTGIFAEFLKLIVGNQADFKKYF--NLEDK-T---PLQ--FAKDSYDEDLEN 278
WP_050886065    213 LTDK-ISKSAKKDRILAQ-Y-PN QKSTGIFAEFLKLIVGNQADFKKYF--NLEDK-T---PLQ--FAKDSYDEDLEN 278
AHN30376        213 LTDK-ISKSAKKDRILAQ-Y-PN QKSTGIFAEFLKLIVGNQADFKKHF--NLEDK-T---PLQ--FAKDSYDEDLEN 278
EAO78426        213 LTDK-ISKSAKKDRILAQ-Y-PN QKSTGIFAEFLKLIVGNQADFKKYF--NLEDK-T---PLQ--FAKDSYDEDLEN 278
CCW42055        213 LTDK-ISKSAKKDRILAQ-Y-PD QKSTGIFAEFLKLIVGNQADFKKHF--NLEDK-T---PLQ--FAKDSYDEDLEN 278
WP_003041502    212 LTEK-VSKSRRLENLIAH-Y-PA EKKNTLFGNLIALFLGLQPNFKTNF--QLSED-A---KLQ--FSKDTYEEDLEG 277
WP_037593752    213 LTEK-VSKSSRLENLIAH-Y-PT EKKNTLFGNLIALSLGLQPNFKTNF--QLSED-A---KLQ--FSKDTYEEDLEE 278
WP_049516684    213 LTEK-VSKSRRLENLVEC-Y-PT EKKNTLFGNLIALSLGLQPNFKTNF--QLSED-A---KLQ--FSKDTYEEDLEG 278
GAD46167        212 LTEK-VSKSSRLENLIAH-Y-PT EKKNTLFGNLIALSLGLQPNFKTNF--QLSED-A---KLQ--FSKDTYEEDLEE 277
WP_018363470    213 LTEK-ISKSRRLENLINN-Y-PK EKKNTLFGNLIALALGLQPNFKTNF--KLSED-A---KLQ--FSKDTYEEDLEE 278
WP_003043819    212 LSAR-LSKSKRLEKLIAV-F-PN EKKNGLFGNIIALALGLTPNFKSNF--DLTED-A---KLQ--LSKDTYDDDLDE 277
WP_006269658    212 LTEK-VSKSSRLENLIAH-Y-PT EKKNTLFGNLIALSLDLHPNFKTNF--QLSED-A---KLQ--FSKDTYEEDLEG 277
WP_048800889    212 LTEK-VSKSRRLENLVKC-Y-PT EKKNTLFGNLIALSLGLQPNFKTNF--QLSED-A---KLQ--FSKDTYEEDLEE 277
WP_012767106    212 LSAR-LSKSKRLENLIAQ-L-PG EKRNGLFGNLIALSLGLTPNFKSNF--DLAED-A---KLQ--LSKDTYDDDLDN 277
WP_014612333    212 LSAR-LSKSKRLENLIAQ-L-PG EKKNGLFGNLIALSLGLTPNFKSNF--DLAED-A---KLQ--LSKDTYDDDLDN 277
WP_015017095    212 LSAR-LSKSKRLENLIAQ-L-PG EKRNGLFGNLIALSLGLTPNFKSNF--DLAED-A---KLQ--LSKDTYDDDLDN 277
WP_015057649    212 LSAR-LSKSKRLENLIAQ-L-PG EKRNGLFGNLIALSLGLTPNFKSNF--DLAED-A---KLQ--LSKDTYDDDLDN 277
WP_048327215    212 LSAR-LSKSKRLENLIAQ-L-PG EKRNGLFGNLIALSLGLTPNFKSNF--DLAED-A---KLQ--LSKDTYDDDLDN 277
WP_049519324    212 LSAR-LSKSKRLENLIAQ-L-PG EKRNGLFGNLIALSLGLTPNFKSNF--DLAED-A---KLQ--LSKDTYDDDLDN 277
WP_012515931    212 LSAA-LSKSKRLENLISL-I-PG QKKTGIFGNIIALSLGLIPNFKANF--GLSKD-V---KLQ--LAKDTYADDLDS 277
WP_021320964    212 LSAA-LSKSKRLENLISL-I-PG QKKTGIFGNIIALSLGLTPNFKANF--GLSKD-V---KLQ--LAKDTYADDLDS 277
WP_037581760    212 LSAA-LSKSKRLENLISL-I-PG QKKTGIFGNIIALSLGLTPNFKANF--GLSKD-V---KLQ--LAKDTYADDLDS 277
WP_004232481    212 LTEK-ISKSRRLENLIKQ-Y-PT EKKNTLFGNLVALALGLQPNFKTNF--KLSED-A---KLQ--FSKDTYDEDLEE 277
WP_009854540    213 LTEK-ISKSRRLENLIKY-Y-PT EKKNTLFGNLIALALGLQPNFKMNF--KLSED-A---KLQ--FSKDTYEEDLEE 278
WP_012962174    213 LTEK-FSKSRRLENLIKH-Y-PT EKKNTLFGNLVALALGLQPNFKTSF--KLSED-A---KLQ--FSKDTYEEDLEE 278
WP_039695303    213 LTEK-ISKSRRLENLIKY-Y-PT EKKNTLFGNLIALALGLQPNFKINF--KLSED-A---KLQ--FSKDTYEEDLEE 278
WP_014334983    212 LTEK-VSKSRRLENLIKQ-Y-PT EKKNTLFGNLIALALGLQPNFKTNF--KLSED-A---KLQ--FSKDTYEEDLEE 277
WP_003099269    212 LTSK-TSKSRRLENLIAE-I-PN QKRNMLFGNLVSLALGLTPNFKTNF--ELLED-A---KLQ--ISKDSYEEDLDN 277
AHY15608        212 LTSK-TSKSRRLENLIAE-I-PN QKRNMLFGNLVSLALGLTPNFKTNF--ELLED-A---KLQ--ISKDSYEEDLDN 277
AHY17476        212 LTSK-TSKSRRLENLIAE-I-PN QKRNMLFGNLVSLALGLTPNFKTNF--ELLED-A---KLQ--ISKDSYEEDLDN 277

ESR09100            -------------------- --------------------------------------------------
```

```
                      -continued
AGM98575        212 LTSK-TSKSRRLENLIAE-I-PN QKRNMLFGNLVSLALGLTPNFKTNF--ELLED-A---KLQ--ISKDSYEEDLDN 277
ALF27331        212 LTDK-ISKSAKKDRVLKL-F-PN EKSNGRFAEFLKLIVGNQADFKKHF--ELEEK-A---PLQ--FSKDTYEEELEV 277
WP_018372492    210 FTEN-SSKAKRVETILGL-F-PD ETAAGNLDKFLKLMLGNQADFKKVF--DLEEK----iTLQ--FSKDSYEEDLEL 275
WP_045618028    213 FTDK-ISKSAKRERVLKL-F-PD EKSTGLFSEFLKLIVGNQADFKKHF--DLEEK-A---PLQ--FSKDTYDEDLEN 278
WP_045635197    212 FTDK-ISKSAKRERVLKL-F-PD EKSTGLFSEFLKLIVGNQADFKKHF--DLEDK-A---PLQ--FSKDTYDEDLEN 277
WP_002263549    212 LTDK-ISKSAKKDRVLKL-F-PN EKSNGRFAEFLKLIVGNQADFKKHF--ELEEK-A---PLQ--FSKDTYEEELEV 277
WP_002263887    212 LTDK-ISKSAKKDRVLKL-F-PN EKSNGRFAEFLKLIVGNQADFKKHF--ELEEK-A---PLQ--FSKDTYEEELEV 277
WP_002264920    212 LTEK-ISKSRRLEKLINN-Y-PK EKKNTLFRNLVALSLGLQPNFKINF--KLSED-A---KLQ--FSKDTYEEDLEE 277
WP_002269043    212 LTDK-ISKSAKKDRVLKL-F-PN EKSNGRFAEFLKLIVGNQADFKKHF--ELEEK-A---PLQ--FSKDIYEEELEV 277
WP_002269448    212 LTDK-ISKSAKKDRVLKL-F-PN EKSNGRFAEFLKLIVGNQADFKKHF--ELEEK-A---PLQ--FSKDTYEEELEV 277
WP_002271977    212 LTDK-ISKSAKKDRVLKL-F-PN EKSNGRFAEFLKLIVGNQADFKKHF--ELEEK-A---PLQ--FSKDTYEEDLEE 277
WP_002272766    212 LTDK-ISKSAKKDRVLKL-F-PN EKSNGRFAEFLKLIVGNQADFKKHF--ELEEK-A---PLQ--FSKDTYEEDLEE 277
WP_002273241    212 LTDK-ISKSAKKDRVLKL-F-PN EKSNGRFAEFLKLIVGNQADFKKHF--ELEEK-A---PLQ--FSKDTYEEELEV 277
WP_002275430    212 LTDK-ISKSAKKDRVLKL-F-PN EKSNGRFAEFLKLIVGNQADFKKHF--ELEEK-A---PLQ--FSKDTYEEELEV 277
WP_002276448    212 LTDK-ISKSAKKDRVLKL-F-PN EKSNGRFAEFLKLIVGNQADFKKHF--ELEEK-A---PLQ--FSKDTYEEELEV 277
WP_002277050    212 LTEK-ISKSRRLEKLINN-Y-PK EKKNTLFGNLIALSLGLQPNFKTNF--KLSED-A---KLQ--FSKDTYEEDLEE 277
WP_002277364    212 LTDK-ISKSAKKDRVLKL-F-PN EKSNGRFAEFLKLIVGNQADFKKHF--ELEEK-A---PLQ--FSKDTYEEELEV 277
WP_002279025    212 LTDK-ISKSAKKDRVLKL-F-PN EKSNGRFAEFLKLIVGNQADFKKHF--ELEEK-A---PLQ--FSKDTYEEELEV 277
WP_002279859    212 LTEK-ISKSRRLEKLINN-Y-PK EKKNTLFGNLIALSLGLQPNFKTNF--KLSED-A---KLQ--FSKDTYEEDLEE 277
WP_002280230    212 LTDK-ISKSAKKDRVLKL-F-PN EKSNGRFAEFLKLIVGNQADFKKHF--ELEEK-A---PLQ--FSKDTYEEELEV 277
WP_002281696    212 LTDK-ISKSAKKDRVLKL-F-PN EKSNGRFAEFLKLIVGNQADFKKHF--ELEEK-A---PLQ--FSKDTYEEELEV 277
WP_002282247    212 LTEK-ISKSRRLEKLINN-Y-PK EKKNTLFGNLIALSLGLQPNFKINF--KLSED-A---KLQ--FSKDTYEEDLEE 277
WP_002282906    212 LTDK-ISKSAKKDRVLKL-F-PN EKSNGRFAEFLKLIVGNQADFKKHF--ELEEK-A---PLQ--FSKDTYEEELEV 277
WP_002283846    212 LTDK-ISKSAKKDRVLKL-F-PN EKSNGRFAEFLKLIVGNQADFKKHF--ELEEK-A---PLQ--FSKDIYEEELEV 277
WP_002287255    212 LTDK-ISKSAKKDRVLKL-F-PN EKSNGRFAEFLKLIVGNQADFKKHF--ELEEK-A---PLQ--FSKDTYEEELEV 277
WP_002288990    212 LTDK-ISKSAKKDRVLKL-F-PN EKSNGRFAEFLKLIVGNQADFKKHF--ELEEK-A---PLQ--FSKDIYEEELEV 277
WP_002289641    212 LTDK-ISKSAKKDRVLKL-F-PN EKSNGCFAEFLKLIVGNQADFKKHF--ELEEK-A---PLQ--FSKDTYEEELEV 277
WP_002290427    212 LTDK-ISKSAKKDRVLKL-F-PN EKSNGRFAEFLKLIVGNQADFKKHF--ELEEK-A---PLQ--FSKDIYEEELEV 277
WP_002295753    212 LTDK-ISKSAKKDRVLKL-F-PN EKSNGRFAEFLKLIVGNQADFKKHF--ELEEK-A---PLQ--FSKDTYEEELEV 277
WP_002296423    212 LTDK-ISKSAKKDRVLKL-F-PN EKSNGRFAEFLKLIVGNQADFKKHF--ELEEK-A---PLQ--FSKDIYEEELEV 277
WP_002304487    212 LTEK-VSKSRRLENLVEC-Y-PT EKKNTLFGNLIALSLGLQPNFKTNF--QLSED-A---KLQ--FSKDTYEEDLEG 277
WP_002305844    212 LTDK-ISKSAKKDRVLKL-F-PN EKSNGRFAEFLKLIVGNQADFKKHF--ELEEK-A---PLQ--FSKDTYEEELEV 277
WP_002307203    212 LTDK-ISKSAKKDRVLKL-F-PN EKSNGRFAEFLKLIVGNQADFKKHF--ELEEK-A---PLQ--LSKDTYEEELEV 277
WP_002310390    212 LTDK-ISKSAKKDRVLKL-F-PN EKSNGRFAEFLKLIVGNQADFKKHF--ELEEK-A---PLQ--FSKDIYEEELEV 277
WP_002352408    212 LTDK-ISKSAKKDRVLKL-F-PN EKSNGRFAEFLKLIVGNQADFKKHF--ELEEK-A---PLQ--FSKDIYEEELEV 277
WP_012997688    212 LTDK-ISKSAKKDRVLKL-F-PN EKSNGRFAEFLKLIVGNQADFKKHF--ELEEK-A---PLQ--FSKDTYEEELEV 277
WP_014677909    212 LTDK-ISKSAKKDRVLKL-F-PN EKSNGRFAEFLKLIVGNQADFKKHF--ELEEK-A---PLQ--FSKDIYEEELEV 277
WP_019312892    212 LTDK-ISKSAKKDRVLKL-F-PN EKSNGRFAEFLKLIVGNQADFKKHF--ELEEK-A---PLQ--FSKDTYEEELEV 277
WP_019313659    212 LTDK-ISKSAKKDRVLKL-F-PN EKSNGRFAEFLKLIIGNQADFKKHF--ELEEK-A---PLQ--FSKDTYEEELEV 277
WP_019314093    212 LTDK-ISKSAKKDRVLKL-F-PN EKSNGRFAEFLKLIVGNQADFKKHF--ELEEK-A---PLQ--LSKDTYEEELEV 277
```

```
WP_019315370  212 LTDK-ISKSAKKDRVLKL-F-PN EKSNGRFAEFLKLIVGNQADFKKHF--ELEEK-A---PLQ--FSKDTYEEELEV 277
WP_019803776  212 LTDK-ISKSAKKDRVLKL-F-PN EKSNGRFAEFLKLIVGNQADFKKHF--ELEEK-V---PLQ--FSKDTYEEELEV 277
WP_019805234  212 LTDK-ISKSAKKDRVLKL-F-PN EKSNGRFAEFLKLIVGNQADFKKHF--ELEEK-A---PLQ--FSKDIYEEELEV 277
WP_024783594  212 LTDK-ISKSAKKDRVLKL-F-PN EKSNGRFAEFLKLIVGNQADFKKHF--ELEEK-A---PLQ--FSKDTYEEELEV 277
WP_024784288  212 LTEK-ISKSRRLEKLINN-Y-PK EKKNTLFGNLIALSLGLQPNFKTNF--KLSED-A---KLQ--FSKDTYEEDLEE 277
WP_024784666  212 LTDK-ISKSAKKDRVLKL-F-PN EKSNGRFAEFLKLIVGNQADFKKHF--ELEEK-A---PLQ--FSKDTYEEELEV 277
WP_024784894  212 LTDK-ISKSAKKDRVLKL-F-PN EKSNGRFAEFLKLIVGNQADFKKHF--ELEEK-A---PLQ--FSKDTYEEELEV 277
WP_024786433  212 LTEK-ISKSRRLEKLINN-Y-PK EKKNTLFGNLIALSLGLQPNFKTNF--KLSED-A---KLQ--FSKDTYEEDLEE 277
WP_049473442  212 LTDK-ISKSAKKDRVLKL-F-PN EKSNGRFAEFLKLIVGNQADFKKHF--ELEEK-A---PLQ--FSKDTYEEDLEE 277
WP_049474547  212 LTDK-ISKSAKKDRVLKL-F-PN EKSNGRFAEFLKLIVGNQADFKKHF--ELEEK-A---PLQ--FSKDTYEEELEV 277
EMC03581      205 LTDK-ISKSAKKDRVLKL-F-PN EKSNGRFAEFLKLIVGNQADFKKHF--ELEEK-A---PLQ--FSKDTYEEELEV 270
WP_000428612  213 FTDK-ISKSAKRERVLKL-F-PD EKSTGLFSEFLKLIVGNQADFKKHF--DLEEK-A---PLQ--FSRDTYDEDLEN 278
WP_000428613  213 FTDK-ISKSAKRERVLKL-F-PD EKSTGLFSEFLKLIVGNQADFKKHF--DLGEK-A---PLQ--FSKDTYDEDLEN 278
WP_049523028  212 FTDK-ISKSAKRDRVLKL-F-PD EKSTGLFSEFLKLIVGNQADFKKHF--DLEEK-A---PLQ--FSKDTYEEDLES 277
WP_003107102  181 LTEK-MSKSRRLENLIAK-I-PN QKKNTLFGNLISLSLGLIPNFKANF--ELSED-A---KLQ--ISKESFEEDLDN 246
WP_054279288  214 LTEK-ISKTRRLENLISN-I-PG QKKNGLFGNLIALSLGLTPNFKSHF--NLPED-A---KLQ--LAKDTYDEELNN 279
WP_049531101  213 FTDK-ISKSTKRERVLKL-F-PD QKSTGLFSEFLKLIVGNQADFKKHF--DLEEK-A---PLQ--FSKDTYDEDLEN 278
WP_049538452  213 FSDK-ISKSAKRERVLKL-F-PD EKSTGLFSEFLKLIVGNQADFKKHF--DLEEK-A---PLQ--FSKDTYDEDLEN 278
WP_049549711  213 FTDK-ISKSAKRERVLKL-F-PD EKSTGLFSEFLKLIVGNQADFKKHF--DLGEK-A---PLQ--FSKDTYDEDLEN 278
WP_007896501  214 LTAK-TSKSKRLESLISE-F-PG QKKNGLFGNLLALALGLRPNFKSNF--GLSED-A---KLQ--ITKDTYEEELDN 279
EFR44625      166 LTAK-TSKSKRLESLISE-F-PG QKKNGLFGNLLALALGLRPNFKSNF--GLSED-A---KLQ--ITKDTYEEELDN 231
WP_002897477  212 FTDK-ISKSAKRERVLKL-F-PD EKSTGLFSEFLKLIVGNQADFKKHF--DLEEK-A---PLQ--FSKDTYDEELEN 277
WP_002906454  212 FTDK-ISKSTKRERVLKL-F-SD EKSTGLFSEFLKLIVGNQADFKKHF--DLEEK-A---PLQ--FSKDTYDEDLEN 277
WP_009729476  213 FTDK-ISKSAKRERVLKL-F-PD EKSTGLFSEFLKLIVGNQADFKKHF--DLEEK-A---PLQ--FSRDTYDEDLEN 278
COR24647      212 ITAK-ISKSRKVEAVLEQ-F-PD QKKNSFFGNMVSLVFGLMPNFKSNF--ELDED-A---KLQ--FSRDSYDEDLEN 277
WP_000066813  213 FTDK-ISKSTKRERVLKL-F-PD EKSTGLFSEFLKLIVGNQADFKKHF--DLEEK-A---PLQ--FSKDTYDEDLEN 278
WP_009754323  213 FTGK-ISKSVKREHVLKL-F-PD EKSTGLFSEFLKLIVGNQADFKKHF--DLEEK-A---SLQ--FSKDTYDEDLEN 278
WP_044674937  212 LVEK-VSKSRRLENILHY-F-PN EKKNGLFGNFLALALGLQPNFKINF--ELAED-A---KIQ--FSKETYEEDLEE 277
WP_044676715  212 LVEK-VSKSRRLENILHY-F-PN EKKNGLFGNFLTLALGLQPNFKTNF--ELAED-A---KIQ--FSKETYEEDLEE 277
WP_044680361  212 LVEK-VSKSRRLENILHY-F-PN EKKNGLFGNFLALALGLQPNFKINF--ELAED-A---KIQ--FSKETYEEDLEE 277
WP_044681799  212 LVEK-VSKSRRLENILHY-F-PN EKKNGLFGNFLALALGLQPNFKTNF--ELAED-A---KIQ--FSKETYEEDLEE 277
WP_049533112  212 LTEK-VSKSRRLENLIAH-Y-PA EKKNTLFGNLIALSLGLQPNFKTNF--QLSED-A---KLQ--FSKDTYEEDLEG 277
WP_029090905  172 LLDRmMNRSSKVKFLIEL---TG KQDKPLLKELFNLIVGLKAKPASIFe---QENlAtivETM-nMSTEQVQLDLLT 243
WP_006506696  211 LKKP-LSKKAKVDEVMTL-IaPE KDYKSAFKELVTGIAGNKMNVTKMIlcEPIKQ-Gds-EIKlkFSDSNYDDQFSE 283
AIT42264      212 LSAR-LSKSRRLENLIAQ-L-PG EKKNGLFGNLIALSLGLTPNFKSNF--DLAED-A---KLQ--LSKDTYDDDLDN 277
WP_034440723  218 FKQD-ISRSKKLDQAIAL-F-QG -KRQSLFGIFLTLIVGNKANFQKIF--NLEDD----iKLD--LKEEDYDENLEE 283
AKQ21048      212 LSAR-LSKSRRLENLIAQ-L-PG EKKNGLFGNLIALSLGLTPNFKSNF--DLAED-A---KLQ--LSKDTYDDDLDN 277
WP_004636532  211 LSSK-QSRSRKHEQIMAL-F-PN ENKLGNFGRFMMLIVGNTSNFKPVF--DLDDE-Y---KLK--LSDETYEEDLDT 276
WP_002364836  218 LTEK-ASRTKKSEKVLQQ-F-PQ EKANGLFGQFLKLMVGNKADFKKVF--GLEEE-A---KI--tYASESYEEDLEG 283
WP_016631044  169 LTEK-ASRTKKSEKVLQQ-F-PQ EKANGLFGQFLKLMVGNKADFKKVF--GLEEE-A---KI--tYASESYEEDLEG 234
EMS75795        1 ---------------------- --------------------------MDEE-A---KIQ--LSKESYEEELES  20
```

-continued

```
WP_002373311  218 LTEK-ASRTKKSEKVLQQ-F-PQ EKANGLFGQFLKLMVGNKADFKKVF--GLEEE-A---KI--tYASESYEEDLEG  283
WP_002378009  218 LTEK-ASRTKKSEKVLQQ-F-PQ EKANGLFGQFLKLMVGNKADFKKVF--GLEEE-A---KI--tYASESYEEDLEG  283
WP_002407324  218 LTEK-ASRTKKSEKVLQQ-F-PQ EKANGLFGQFLKLMVGNKADFKKVF--GLEEE-A---KI--tYASESYEEDLEG  283
WP_002413717  218 LTEK-ASRTKKSEKVLQQ-F-PQ EKANGLFGQFLKLMVGNKADFKKVF--GLEEE-A---KI--tYASESYEEDLEG  283
WP_010775580  218 LTEK-ASRTKKSEKVLQQ-F-PQ EKANGLFGQFLKLMVGNKADFKKVF--GLEEE-A---KIKitYASESYEEDLEG  285
WP_010818269  218 LTEK-ASRTKKSEKVLQQ-F-PQ EKANGLFGQFLKLMVGNKADFKKVF--GLEEE-A---KI--tYASESYEEDLEG  283
WP_010824395  218 LTEK-ASRTKKSEKVLQQ-F-PQ EKANGLFGQFLKLMVGNKADFKKVF--GLEEE-A---KI--tYASESYEEDLEG  283
WP_016622645  218 LTEK-ASRTKKSEKVLQQ-F-PQ EKANGLFGQFLKLMVGNKADFKKVF--GLEEE-A---KI--tYASESYEEDLEG  283
WP_033624816  218 LTEK-ASRTKKSEKVLQQ-F-PQ EKANGLFGQFLKLMVGNKADFKKVF--GLEEE-A---KI--tYASESYEEDLEG  283
WP_033625576  218 LTEK-ASRTKKSEKVLQQ-F-PQ EKANGLFGQFLKLMVGNKADFKKVF--GLEEE-A---KI--tYASESYEEDLEG  283
WP_033789179  218 LTEK-ASRTKKSEKVLQQ-F-PQ EKANGLFGQFLKLMVGNKADFKKVF--GLEEE-A---KI--tYASESYEEDLEG  283
WP_002310644  217 FTEK-MSKTKKAETLLKY-F-PH EKSNGYLSQFIKLMVGNQGNFKNVF--GL-EE-A---KLQ--FSKETYEEDLEE  281
WP_002312694  217 FTEK-MSKTKKAETLLKY-F-PH EKSNGYLSQFIKLMVGNQGNFKNVF--GL-EEeA---KLQ--FSKETYEEDLEE  282
WP_002314015  217 FTEK-MSKTKKAETLLKY-F-PH EKSNGYLSQFIKLMVGNQGNFKNVF--GL-EEeA---KLQ--FSKETYEEDLEE  282
WP_002320716  217 FTEK-MSKTKKAETLLKY-F-PH EKSNGYLSQFIKLMVGNQGNFKNVF--GL-EEeA---KLQ--FSKETYEEDLEE  282
WP_002330729  217 FTEK-MSKTKKAETLLKY-F-PH EKSNGYLSQFIKLMVGNQGNFKNVF--GL-EE-A---KLQ--FSKETYEEDLEE  281
WP_002335161  217 FTEK-MSKTKKAETLLKY-F-PH EKSNGYLSQFIKLMVGNQGNFKNVF--GL-EEeA---KLQ--FSKETYEEDLEE  282
WP_002345439  217 FTEK-MSKTKKAETLLKY-F-PH EKSNGYLSQFIKLMVGNQGNFKNVF--GL-EEeA---KLQ--FSKETYEEDLEE  282
WP_034867970  210 LTDK-LSKTKKVEEILKY-Y-PT EKINSFFAQCLKLIVGNQANFKRIF--DLEAE-V---KLQ--FSKETYEEDLES  275
WP_047937432  217 FTEK-MSKTKKAETLLKY-F-PH EKSNGYLSQFIKLMVGNQGNFKNVF--GL-EEeA---KLQ--FSKETYEEDLEE  282
WP_010720994  210 LTDK-LSKTKKVEEILKY-Y-PT EKINSFFAQCLKLIVGNQANFKRIF--DLEAE-V---KLQ--FSKETYEEDLES  275
WP_010737004  210 LTDK-LSKTKKVEEILKY-Y-PT EKINSFFAQCLKLIVGNQANFKRIF--DLEAE-V---KLQ--FSKETYEEDLES  275
WP_034700478  210 LTDK-LSKTKKVEEILKY-Y-PT EKINSFFAQCLKLIVGNQANFKRIF--DLEAE-V---KLQ--FSKETYEEDLES  275
WP_007209003  215 LTQQ-LSKSERADNVLKL-F-PD EKGTGIFAQFIKLIVGNQGNFKKVF--QLEED----qKLQ--LSTDDYEENIEN  280
WP_023519017  210 LTER-LSKAKRVEKVLAY-Y-PS EKSTGNFAQFLKLMVGNQANFKKTF--DLEEE-M---KLN--FTRDCYEEDLNE  275
WP_010770040  213 FSEK-VSRARKVEAILSV-Y-SE EKSTGTLAQFLKLMVGNQGRFKKTF--DLEED-G---IIQ--IPKEEYEEELET  278
WP_048604708  209 FADK-VSRAKKAEGVLAL-F-PD EKRNGTFDQFLKMIVGNQGNFKKTF--ELEED-A---KLQ--FSKEEYDESLEA  274
WP_010750235  210 LTDK-LSKSKKVEKILQY-Y-PK EKTTGCLAQFLKLIVGNQGNFKQAF--HLDEE-V---KIQ--ISKETYEEDLEK  275
AII16583      251 LSAR-LSKSRRLENLIAQ-L-PG EKKNGLFGNLIALSLGLTPNFKSNF--DLAED-A---KLQ--LSKDTYDDDLDN  316
WP_029073316  216 LKEP-LSKKHKADKAFAL-FdTT KDNKAAYKELCAALAGNKFNVTKMLkeAELHD-EdekDISfkFSDATFDDAFVE  289
WP_031589969  216 LKEP-LSKKHKAEKAFAL-FdTT KDNKAAYKELCAALAGNKFNVTKMLkeAELHD-EdekDISfkFSDATFDDAFVE  289
KDA45870      210 FKDNtFSKTKKSEELLKL---SG -KKNQLAHQLFKMMVGNMGSFKKVL--GTDEE----hKLS--FGKDTYEDDLND  275
WP_039099354  207 LLDNhQSASNRQRQALLLiYtPS KQNKAIATELLKAILGLKAKFNVLT--GIEAEdVktwTLT--FNAENFDEEMVK  285
AKP02966      209 LIGR-GNATQKSSNILNN-F--T KETKKLLKEVINLILGNVAHLNTIFktSLTKDeE---KLS--FSGKDIESKLDD  278
WP_010991369  218 LVEK-VTRKEKLERILKL-Y-PG EKSAGMFAQFISLIVGSKGNFQKPF--DLIEK-S---DIE--CAKDSYEEDLES  283
WP_033838504  218 LVEK-VTRKEKLERILKL-Y-PG EKSAGMFAQFISLIVGSKGNFQKPF--DLIEK-S---DIE--CAKDSYEEDLES  283
EHN60060      221 LVEK-VTRKEKLERILKL-Y-PG EKSAGMFAQFISLIVGSKGNFQKPF--DLIEK-S---DIE--CAKDSYEEDLES  286
EFR89594        1 ---------------LKL-Y-PG EKSTGMFAQFISLIVGSKGNFQKPF--DLIEK-S---DIE--CAKDSYEEDLES   52
WP_038409211  218 LSEK-LTRREKLDKILKL-Y-TG EKSTGMFARFINLIIGSKGDFKKVF--DLDEK-A---EIE--CAKDTYEEDLEA  283
EFR95520          -------------------    ----------------------------------------------------
```

-continued

```
WP_003723650   218 LAGK-FTRREKFERILQL-Y-PG EKSTGMFAQFISLIVGSKGNFQKVF--DLIEK-T---DIE--CAKDSYEEDLET 283
WP_003727705   218 LAGK-FTRREKFERILRL-Y-PG EKSTGMFAQFISLIVGNKGNFQKVF--NLVEK-T---DIE--CAKDSYEEDLEA 283
WP_003730785   218 LAGK-FTRREKFERILRL-Y-PG EKSTGMFAQFISLIVGNKGNFQKVF--NLVEK-T---DIE--CAKDSYEEDLEA 283
WP_003733029   218 LAEK-FTRKDKLDKILSL-Y-PG EKTTGVFAQFVNIIVGSTGKFKKHF--NLHEK-K---DIN--CAEDTYDTDLES 283
WP_003739838   218 LAGK-FTRKEKLERILQL-Y-PG EKSTGMFAQFISLIVGSKGNFQKVF--DLVEK-T---DIE--CAKDSYEEDLEA 283
WP_014601172   218 LAGK-FTRREKFERILQL-Y-PG EKSTGMFAQFISLIVGSKGNFQKVF--DLIEK-T---DIE--CAKDSYEEDLEA 283
WP_023548323   218 LAGK-FTRREKFERILQL-Y-PG EKSTGMFAQFISLIVGSKGNFQKVF--DLIEK-T---DIE--CAKDSYEEDLET 283
WP_031665337   218 LAGK-FTRREKFERILQL-Y-PG EKSTGMFAQFISLIVGSKGNFQKVF--DLIEK-T---DIE--CAKDSYEEDLET 283
WP_031669209   218 LAEK-FTRKDKLDKILSL-Y-PG EKTTGVFAQFVNIIVGSTGKFKKHF--NLHEK-K---DIN--CAEDTYDTDLES 283
WP_033920898   218 LARK-FTRREKFERILQL-Y-PG EKSTGMFAQFISLIVGSKGNFQKVF--DLIEK-T---DIE--CAKDSYEEDLET 283
AKI42028       221 LAGK-FTRREKFERILQL-Y-PG EKSTGMFAQFISLIVGSKGNFQKVF--DLIEK-T---DIE--CAKDSYEEDLEA 286
AKI50529       221 LARK-FTRREKFERILQL-Y-PG EKSTGMFAQFISLIVGSKGNFQKVF--DLIEK-T---DIE--CAKDSYEEDLET 286
EFR83390           ---------------------- -----------------------------------------------------
WP_046323366   218 FSEK-LTKREKLDKILNL-Y-PN EKSTDLFAQFISLIIGSKGNFKKFF--NLTEK-T---DIE--CAKDSYEEDLEV 283
AKE81011       228 LSAR-LSKSRRLENLIAQ-L-PG EKKNGLFGNLIALSLGLTPNFKSNF--DLAED-A---KLQ--LSKDTYDDDLDN 293
CUO82355       215 LKKP-LSKKAKVDEVMAL-ISPE KEFKSAYKELVTGIAGNKMNVTKMIICESIKQ-Gds-EIKlkFSDSNYDDQFSE 287
WP_033162887   216 LSKI-YQRSKKADDLLKI-MnPT KEEKAAYKEFTKALVGLKFNISKMIlaQEVKK-Gdt-DIVleFSNANYDSTIDE 288
AGZ01981       245 LSAR-LSKSRRLENLIAQ-L-PG EKKNGLFGNLIALSLGLTPNFKSNF--DLAED-A---KLQ--LSKDTYDDDLDN 310
AKA60242       212 LSAR-LSKSRRLENLIAQ-L-PG EKKNGLFGNLIALSLGLTPNFKSNF--DLAED-A---KLQ--LSKDTYDDDLDN 277
AKS40380       212 LSAR-LSKSRRLENLIAQ-L-PG EKKNGLFGNLIALSLGLTPNFKSNF--DLAED-A---KLQ--LSKDTYDDDLDN 277
4UN5_B         216 LSAR-LSKSRRLENLIAQ-L-PG EKKNGLFGNLIALSLGLTPNFKSNF--DLAED-A---KLQ--LSKDTYDDDLDN 281
WP_010922251   278 LLAQIGDQYADLFLAAKNLSDAILLSDILRVNTEITKAPLSASMIKRYDEHHQDLTLLKALVRQQ-LPEKYKEIFFDQSK 356
WP_039695303   279 LLGKIGDDYADLFTSAKNLYDAILLSGILTVDDNSTKAPLSASMIKRYVEHHEDLEKLKEFIKAN-KSELYHDIFKDKNK 357
WP_045635197   278 LLGQIGDDFTDLFVSAKKLYDAILLSGILTVTDPSTKAPLSASMIERYENHQNDLAALKQFIKNN-LPEKYDEVFSDQSK 356
5AXW_A         158 -------------------------------LERLKKDG-------EVR----- 168
WP_009880683     1 ----------------------------------LSASMIKRYDEHHQDLTLLKALVRQQ-LPEKYKEIFFDQSK  40
WP_010922251   278 LLAQIGDQYADLFLAAKNLSDAILLSDILRVNTEITKAPLSASMIKRYDEHHQDLTLLKALVRQQ-LPEKYKEIFFDQSK 356
WP_011054416   278 LLAQIGDQYADLFLAAKNLSDATLLSDILRVNSEITKAPLSASMIKRYDEHHQDLTLLKALVRQQ-LPEKYKEIFFDQSK 356
WP_011284745   278 LLAQIGDQYADLFLAAKNLSDAILLSDILRLNSEITKAPLSASMIKRYDEHHQDLTLLKALVRQQ-LPEKYKEIFFDQSK 356
WP_011285506   278 LLAQIGDQYADLFLAAKNLSDAILLSDILRVNTEITKAPLSASMIKRYDEHHQDLTLLKALVRQQ-LPEKYKEIFFDQSK 356
WP_011527619   278 LLAQIGDQYADLFLAAKNLSDAILLSDILRLNSEITKAPLSASMIKRYDEHHQDLTLLKALVRQQ-LPEKYKEIFFDQSK 356
WP_012560673   278 LLAQIGDQYADLFLAAKNLSDAILLSDILRVNTEITKAPLSASMIKRYDEHHQDLTLLKALVRQQ-LPEKYKEIFFDQSK 356
WP_014407541   278 LLAQIGDQYADLFLAAKNLSDAILLSDILRVNSEITKAPLSASMIKRYDEHHQDLTLLKALVRQQ-LPEKYKEIFFDQSK 356
WP_020905136   278 LLAQIGDQYADLFLAAKNLSDAILLSDILRLNSEITKAPLSASMIKRYDEHHQDLTLLKALVRQQ-LPEKYKEIFFDQSK 356
WP_023080005   278 LLAQIGDQYADLFLAAKNLSDAILLSDILRVNSEITKAPLSASMIKRYDEHHQDLTLLKALVRQQ-LPEKYKEIFFDQSK 356
WP_023610282   278 LLAQIGDQYADLFLAAKNLSDAILLSDILRVNSEITKAPLSASMIKRYDEHHQDLTLLKALVRQQ-LPEKYKEIFFDQSK 356
WP_030125963   278 LLAQIGDQYADLFLAAKNLSDAILLSDILRVNTEITKASLSASMIKRYDEHHQDLTLLKALVRQQ-LPEKYKEIFFDQSK 356
WP_030126706   278 LLAQIGDQYADLFLAAKNLSDATLLSDILRVNTEITKAPLSASMIKRYDEHHQDLTLLKALVRQQ-LPEKYKEIFFDQSK 356
WP_031488318   278 LLAQIGDQYADLFLAAKNLSDAILLSDILRVNSEITKAPLSASMIKRYDEHHQDLTLLKALVRQQ-LPEKYKEIFFDQSK 356
WP_032460140   278 LLAQIGDQYADLFLAAKNLSDAILLSDILRVNTEITKAPLSASMIKRYDEHHQDLTLLKALVRQQ-LPEKYKEIFFDQSK 356
```

-continued

```
WP_032461047   278 LLAQIGDQYADLFLAAKNLSDAILLSDILRVNTEITKAPLSASMIKRYDEHHQDLTLLKALVRQQ-LPEKYKEIFFDQSK 356
WP_032462016   278 LLAQIGDQYADLFLAAKNLSDAILLSDILRVNTEITKAPLSASMIKRYDEHHQDLTLLKALVRQQ-LPEKYKEIFFDQSK 356
WP_032462936   278 LLAQIGDQYADLFLAAKNLSDAILLSDILRVNSEITKAPLSASMIKRYDEHHQDLTLLKALVRQQ-LPEKYKEIFFDQSK 356
WP_032464890   278 LLAQIGDQYADLFLAAKNLSDAILLSDILRLNSEITKAPLSASMIKRYDEHHQDLTLLKALVRQQ-LPEKYKEIFFDQSK 356
WP_033888930   103 LLAQIGDQYADLFLAAKNLSDAILLSDILRVNTEITKAPLSASMIKRYDEHHQDLTLLKALVRQQ-LPEKYKEIFFDQSK 181
WP_038431314   278 LLAQIGDQYADLFLAAKNLSDATLLSDILRVNSEITKAPLSASMIKRYDEHHQDLTLLKALVRQQ-LPEKYKEIFFDQSK 356
WP_038432938   278 LLAQIGDQYADLFLAAKNLSDAILLSDILRVNSEITKAPLSASMIKRYDEHHQDLTLLKALVRQQ-LPEKYKEIFFDQSK 356
WP_038434062   278 LLAQIGDQYADLFLAAKNLSDAILLSDILRVNSEITKAPLSASMIKRYDEHHQDLTLLKALVRQQ-LPEKYKEIFFDQSK 356
BAQ51233       189 LLAQIGDQYADLFLAAKNLSDAILLSDILRVNTEITKAPLSASMIKRYDEHHQDLTLLKALVRQQ-LPEKYKEIFFDQSK 267
KGE60162           --------------------------------------------------------------------------------
KGE60856           --------------------------------------------------------------------------------
WP_002989955   278 LLAQIGDQYADLFLAAKNLSDAILLSDILRLNSEITKAPLSASMIKRYDEHHQDLTLLKALVRQQ-LPEKYKEIFFDQSK 356
WP_003030002   278 LLGEIGDEYADLFASAKNLYDAILLSGILTVDDNSTKAPLSASMVKRYEEHQKDLKKLKDFIKVN-APDQYNAIFKDKNK 356
WP_003065552   281 LLGKIGDDYADLFTSAKNLYDAILLSGILIVDDNSTKAPLSASMIKRYVEHQEDLEKLKEFIKAN-KSELYHDIFKDKNK 359
WP_001040076   279 LLGQIGDEFADLFSAAKKLYDSVLLSGILTVTDLSTKAPLSASMIQRYDEHREDLKQLKQFVKAS-LPEKYQEIVADSSK 357
WP_001040078   279 LLGQIGDEFADLFSAAKKLYDSVLLSGILTVIDLSTKAPLSASMIQRYDEHREDLKQLKQFVKAS-LPEKYQEIFADSSK 357
WP_001040080   279 LLGQIGDEFADLFSAAKKLYDSVLLSGILTVIDLSTKAPLSASMIQRYDEHREDLKQLKQFVKAS-LPEKYQEIFADSSK 357
WP_001040081   279 LLGQIGDEFADLFSAAKKLYDSVLLSGILTVIDLSTKAPLSASMIQRYDEHREDLKQLKQFVKAS-LPEKYQEIFADSSK 357
WP_001040083   279 LLGQIGDEFADLFSAAKKLYDSVLLSGILTVIDLSTKAPLSASMIQRYDEHREDLKQLKQFVKAS-LPEKYQEIFADSSK 357
WP_001040085   279 LLGQIGDEFADLFSAAKKLYDSVLLSGILTVIDLSTKAPLSASMIQRYDEHREDLKQLKQFVKAS-LPEKYQEIFADSSK 357
WP_001040087   279 LLGQIGDEFADLFSAAKKLYDSVLLSGILTVIDLSTKAPLSASMIQRYDEHREDLKQLKQFVKAS-LPEKYQEIFADSSK 357
WP_001040088   279 LLGQIGDEFADLFSAAKKLYDSVLLSGILTVIDLSTKAPLSASMIQRYDEHREDLKQLKQFVKAS-LPEKYQEIFADSSK 357
WP_001040089   279 LLGQIGDEFADLFSAAKKLYDSVLLSGILTVIDLSTKAPLSASMIQRYDEHREDLKQLKQFVKAS-LPEKYQEIFADSSK 357
WP_001040090   279 LLGQIGDEFADLFSAAKKLYDSVLLSGILTVIDLSTKAPLSASMIQRYDEHREDLKQLKQFVKAS-LPEKYQEIFADSSK 357
WP_001040091   279 LLRQIGDEFADLFSAAKKLYDSVLLSGILTVIDLSTKAPLSASMIQRYDEHREDLKQLKQFVKAS-LPEKYQEIFADSSK 357
WP_001040092   279 LLGQIGDEFADLFSAAKKLYDSVLLSGILTVTDLSTKAPLSAYMIQRYDEHREDLKQLKQFVKAS-LPEKYQEIFADSSK 357
WP_001040094   279 LLGQIGDEFADLFSAAKKLYDSVLLSGILTVTDLSTKAPLSASMIQHYDEHREDLKQLKQFVKAS-LPEKYQEIFADSSK 357
WP_001040095   279 LLGQIGDEFADLFSAAKKLYDSVLLSGILTVTDLSTKAPLSASMIQRYDEHREDLKQLKQFVKAS-LPEKYQEIFADSSK 357
WP_001040096   279 LLGQIGDEFADLFSAAKKLYDSVLLSGILTVTDLSTKAPLSASMIQRYDEHREDLKQLKQFVKAS-LPEKYQEIFADSSK 357
WP_001040097   279 LLGQIGDEFADLFSAAKKLYDSVLLSGILTVTDLSTKAPLSASMIQRYDEHREDLKQLKQFVKAS-LPEKYQEIFADSSK 357
WP_001040098   279 LLGQIGDEFADLFSAAKKLYDSVLLSGILTVTDLSTKAPLSASMIQRYDEHREDLKQLKQFVKAS-LPEKYQEIFADSSK 357
WP_001040099   279 LLGQIGDEFADLFSAAKKLYDSVLLSGILTVTDLSTKAPLSASMIQRYDEHREDLKQLKQFVKAS-LPEKYQEIFADSSK 357
WP_001040100   279 LLGQIGDEFADLFSAAKKLYDSVLLSGILTVTDLSTKAPLSASMIQRYDEHREDLKQLKQFVKAS-LPEKYQEIFADSSK 357
WP_001040104   279 LLGQIGDEFADLFSAAKKLYDSVLLSGILTVIDLSTKAPLSASMIQRYDEHREDLKQLKQFVKAS-LPEKYQEIFADSSK 357
WP_001040105   279 LLGQIGDEFADLFSAAKKLYDSVLLSGILTVIDLSTKAPLSASMIQRYDEHREDLKQLKQFVKAS-LPEKYQEIFADSSK 357
WP_001040106   279 LLGQIGDEFADLFSVAKKLYDSVLLSGILTVTDLSTKAPLSASMIQRYDEHREDLKQLKQFVKAS-LPEKYQEIFTDSSK 357
WP_001040107   279 LLGQIGDEFADLFSVAKKLYDSVLLSGILTVTDLSTKAPLSASMIQRYDEHREDLKQLKQFVKAS-LPEKYQEIFTDSSK 357
WP_001040108   279 LLGQIGDEFADLFSVAKKLYDSVLLSGILTVTDLSTKAPLSASMIQRYDEHREDLKQLKQFVKAS-LPEKYQEIFTDSSK 357
WP_001040109   279 LLGQIGDEFADLFSVAKKLYDSVLLSGILTVTDLSTKAPLSASMIQRYDEHREDLKQLKQFVKAS-LPEKYQEIFTDSSK 357
WP_001040110   279 LLGQIGDEFADLFSVAKKLYDSVLLSGILTVTDLSTKAPLSASMIQRYDEHREDLKQLKQFVKAS-LPEKYQEIFTDSSK 357
WP_015058523   279 LLGQIGDEFADLFSAAKKLYDSVLLSGILTVTDLSTKAPLSASMIQRYDEHREDLKQLKQFVKAS-LPEKYQEIFADSSK 357
```

-continued

```
WP_017643650    279  LLGQIGDEFADLFSAAKKLYDSVLLSGILTVTDLSTKAPLSASMIQRYDEHREDLKQLKQFVKAS-LPEKYQEIFADSSK  357
WP_017647151    279  LLGQIGDEFADLFSVAKKLYDSVLLSGILTVTDLSTKAPLSASMIQRYDEHREDLKQLKQFVKAS-LPEKYQEIFTDSSK  357
WP_017648376    279  LLGQIGDEFADLFSVAKKLYDSVLLSGILTVTDLSTKAPLSASMIQRYDEHREDLKQLKQFVKAS-LPEKYQEIFTDSSK  357
WP_017649527    279  LLGQIGDEFADLFSAAKKLYDSVLLSGILTVIDLSTKAPLSASMIQRYDEHREDLKQLKQFVKAS-LPEKYQEIFADSSK  357
WP_017771611    279  LLGQIGDEFADLFSVAKKLYDSVLLSGILTVTALSTKAPLSASMIQRYDEHREDLKQLKQFVKAS-LPEKYQEIFTDSSK  357
WP_017771984    279  LLGQIGDEFADLFSAAKKLYDSVLLSGILTVIDLSTKAPLSASMIQRYDEHREDLKQLKQFVKAS-LPEKYQEIFADSSK  357
CFQ25032        279  LLGQIGDEFADLFSAAKKLYDSVLLSGILTVIDLSTKASLSDSMIQRYDEHREDLKQLKQFVKAS-LPEKYQEIFADSSK  357
CFV16040        279  LLGQIGDEFADLFSAAKKLYDSVLLSGILTVIDLSTKAPLSASMIQRYDEHREDLKQLKQFVKAS-LPEKYQEIFADSSK  357
KLJ37842        279  LLGQIGDEFADLFSAAKKLYDSVLLSGILTVIDLSTKAPLSASMIQRYDEHREDLKQLKQFVKAS-LPEKYQEIFADSSK  357
KLJ72361        279  LLGQIGDEFADLFSAAKKLYDSVLLSGILTVIDLSTKAPLSASMIQRYDEHREDLKQLKQFVKAS-LPEKYQEIFADSSK  357
KLL20707        279  LLGQIGDEFADLFSAAKKLYDSVLLSGILTVIDLSTKAPLSASMIQRYDEHREDLKQLKQFVKAS-LPEKYQEIFADSSK  357
KLL42645        279  LLGQIGDEFADLFSVAKKLYDSVLLSGILTVTDLSTKAPLSASMIQRYDEHREDLKQLKQFVKAS-LPEKYQEIFTDSSK  357
WP_047207273    279  LLGQIGDEFADLFSAAKKLYDSVLLSGILTVIDLSTKAPLSASMIQRYDEHREDLKQLKQFVKAS-LPEKYQEIFADSSK  357
WP_047209694    279  LLGQIGDEFADLFSAAKKLYDSVLLSGILTVTDLSTKAPLSASMIQRYDEHREDLKQLKQFVKAS-LPEKYQEIFADSSK  357
WP_050198062    279  LLGQIGDEFADLFSAAKKLYDSVLLSGILTVIDLSTKAPLSASMIQRYDEHREDLKQLKQFVKAS-LPEKYQEIFADSSK  357
WP_050201642    279  LLGQIGDEFADLFSAAKKLYDSVLLSGILTVTDLSTKAPLSASMIQRYDEHREDLKQLKQFVKAS-LPEKYQEIFADSSK  357
WP_050204027    279  LLGQIGDEFADLFSVAKKLYDSVLLSGILTVTDLSTKAPLSASMIQRYDEHREDLKQLKQFVKAS-LPEKYQEIFTDSSK  357
WP_050881965    279  LLGQIGDEFADLFSAAKKLYDSVLLSGILTVIDLSTKAPLSASMIQRYDEHREDLKQLKQFVKAS-LPEKYQEIFADSSK  357
WP_050886065    279  LLGQIGDEFADLFSAAKKLYDSVLLSGILTVIDLSTKAPLSASMIQRYDEHREDLKQLKQFVKAS-LPEKYQEIFADSSK  357
AHN30376        279  LLGQIGDEFADLFSAAKKLYDSVLLSGILTVTDLSTKAPLSASMIQRYDEHREDLKQLKQFVKAS-LPEKYQEIFADSSK  357
EAO78426        279  LLGQIGDEFADLFSAAKKLYDSVLLSGILTVIDLSTKAPLSASMIQRYDEHREDLKQLKQFVKAS-LPEKYQEIFADSSK  357
CCW42055        279  LLGQIGDEFADLFSAAKKLYDSVLLSGILTVTDLSTKAPLSASMIQRYDEHREDLKQLKQFVKAS-LPEKYQEIFADSSK  357
WP_003041502    278  LLGEVGDEYADLFASAKNLYDAILLSGILTVDDNSTKAPLSASMVKRYEEHQKDLKKFEDFIKVN-ALDQYNAIFKDKNK  356
WP_037593752    279  LLGEIGDEYADLFASAKNLYDAILLSGILAVDDNTTKAPLSASMVKRYEEHQKDLKKLKDFIKVN-APDQYNAIFKDKNK  357
WP_049516684    279  LLGEIGDEYADLFASAKNLYDAILLSGILAVDDNTTKAPLSASMVKRYEEHQKDLKKLKDFIKVN-APAQYDDIFKDETK  357
GAD46167        278  LLGEIGDEYADLFASAKNLYDAILLSGILAVDDNTTKAPLSASMVKRYEEHQKDLKKLKDFIKVN-APDQYNAIFKDKNK  356
WP_018363470    279  LLGKIGDDYADLFTSSKNLYDAILLSGILTVDDNSTKAPLSASMIKRYVEHHEDLEKLKEFIKAN-KSELYHDIFKDKTQ  357
WP_003043819    278  LLGQIGDQYADLFSAAKNLSDAILLSDILRSNSEVTKAPLSASMVKRYDEHHQDLALLKTLVRQQ-FPEKYAEIFKDDTK  356
WP_006269658    278  FLGEVGDEYADLFASAKNLYDAILLSGILTVDDNSTKAPLSASMVKRYEEHQKDLKKLKDFIKVN-APDQYNAIFKDKNK  356
WP_048800889    278  LLGKIGDDYADLFTSAKNLYDTILLSGILAVDDNSTKALLSASMIKRYEEHQKDLKKLKDFIKVN-APAQYDDIFKDETK  356
WP_012767106    278  LLAQIGDQYADLFLAAKNLSDAILLSDILRVNSEITKAPLSASMIKRYDEHHQDLTLLKALVRQQ-LPEKYKEIFFDQSK  356
WP_014612333    278  LLAQIGNQYADLFLAAKNLSDAILLSDILRVNSEITKAPLSASMIKRYDEHHQDLTLLKALVRQQ-LPEKYKEIFFDQSK  356
WP_015017095    278  LLAQIGDQYADLFLAAKNLSDAILLSDILRVNSEITKAPLSASMIKRYDEHHQDLTLLKALVRQQ-LPEKYKEIFFDQSK  356
WP_015057649    278  LLAQIGDQYADLFLAAKNLSDAILLSDILRVNSEITKAPLSASMIKRYDEHHQDLTLLKALVRQQ-LPEKYKEIFFDQSK  356
WP_048327215    278  LLAQIGDQYADLFLAAKNLSDAILLSDILRVNSEITKAPLSASMIKRYDEHHQDLTLLKALVRQQ-LPEKYKEIFFDQSK  356
WP_049519324    278  LLAQIGDQYADLFLAAKNLSDAILLSDILRVNSEITKAPLSASMIKRYDEHHQDLTLLKALVRQQ-LPEKYKEIFFDQSK  356
WP_012515931    278  LLAQIGDQYADLFLAAKNLSDAILLSDILTESDEITRAPLSASMVKRYEHHKDLVILKTLIKDQ-LPEKYQEIFLDKTK  356
WP_021320964    278  LLAQIGDQYADLFLAAKNLSDAILLSDILTESDEITRAPLSASMVKRYEHHKDLVILKTLIKDQ-LPEKYQEIFLDKTK  356
WP_037581760    278  LLAQIGDQYADLFLAAKNLSDAILLSDILTESDEITRAPLSASMVKRYEHHKDLVTLKTLIKDQ-LPEKYQEIFLDKTK  356
WP_004232481    278  LLGKIGDDYADLFTAAKNLYDAILLSGILTVDDNSTKAPLSASMIKRYEEHHEDLEKLKTFIKVN-NFDKYHEIFKDKSK  356
```

```
WP_009854540   279 LLGKIGDDYADLFTSAKNLYDAILLSGILTVDDNSTKAPLSASMIKRYVEHHEDLEKLKEFIKAN-KSELYHDIFKDKNK 357
WP_012962174   279 LIGKIGDEYADLFTSAKNLYDAILLSGILTVADNTTKAPLSASMIKRYNEHQVDLKKLKEFIKNN-ASDKYDEIFNDKDK 357
WP_039695303   279 LLGKIGDDYADLFTSAKNLYDAILLSGILTVDDNSTKAPLSASMIKRYVEHHEDLEKLKEFIKAN-KSELYHDIFKDKNK 357
WP_014334983   278 LLGKVGDDYADLFISAKNLYDAILLSGILTVDDNSTKAPLSASMIKRYVEHHEDLEKLKEFIKIN-KLKLYHDIFKDKTK 356
WP_003099269   278 LLAQIGDQYADLFIAAKKLSDAILLSDIITVKGASTKAPLSASMVQRYEEHQQDLALLKNLVKKQ-IPEKYKEIFDNKEK 356
AHY15608       278 LLAQIGDQYADLFIAAKKLSDAILLSDIITVKGASTKAPLSASMVQRYEEHQQDLALLKNLVKKQ-IPEKYKEIFDNKEK 356
AHY17476       278 LLAQIGDQYADLFIAAKKLSDAILLSDIITVKGASTKAPLSASMVQRYEEHQQDLALLKNLVKKQ-IPEKYKEIFDNKEK 356
ESR09100           --------------------------------------------------------------------------------
AGM98575       278 LLAQIGDQYADLFIAAKKLSDAILLSDIITVKGASTKAPLSASMVQRYEEHQQDLALLKNLVKKQ-IPEKYKEIFDNKEK 356
ALF27331       278 LLAQIEDNYAELFLSAKKLYDSILLSGILTVTDVSTKAPLSASMIQRYNEHQMDLAQLKQFIRQK-LSDKYNEVESDVSK 356
WP_018372492   276 LLSKIDEEYAALFDLAKKVYDAVLLSNILTVKEKNTKAPLSASMIKRYEEHKDDLKAFKRFFRER-LPEKYETMFKDLTK 354
WP_045618028   279 LLVQIGDDFADLFLVAKKLYDAILLSGILTVTDPSTKAPLSASMIDRYENHQKDLAALKQFIKTN-LPEKYDEVFSDQSK 357
WP_045635197   278 LLGQIGDDFTDLFVSAKKLYDAILLSGILTVTDPSTKAPLSASMIERYENHQNDLAALKQFIKNN-LPEKYDEVESDQSK 356
WP_002263549   278 LLAQIGDNYAELFLSAKKLYDSILLSGILTVTDVGTKAPLSASMIQRYNEHQMDLAQLKQFIRQK-LSDKYNEVESDVSK 356
WP_002263887   278 LLAQIGDNYAELFLSAKKLYDSILLSGILTVTDVGTKAPLSASMIQRYNEHQMDLAQLKQFIRQK-LSDKYNEVESDVSK 356
WP_002264920   278 LLGKIGDDYADLFTLAKNLYDAILLSGILTADDSSTKAPLSASMIKRYAEHHEDLEKLKEFIKAN-KPELYHDIFKDETK 356
WP_002269043   278 LLAQIGDNYAELFLSAKKLYDSILLSGILTVTDVSTKAPLSASMIQRYNEHQMDLAQLKQFIRQK-LSDKYNEVESDVSK 356
WP_002269448   278 LLAQIGDNYAELFLSAKKLYDSILLSGILTVTDVSTKAPLSASMIQRYNEHQMDLAQLKQFIRQK-LSDKYNEVESDVSK 356
WP_002271977   278 LLGKIGDDYADLFTLAKNLYDAILLSGILTADDSSTKAPLSASMIQRYNEHQMDLAQLKQFIRQK-LSDKYNEVESDVSK 356
WP_002272766   278 LLGKIGDDYADLFTLAKNLYDAILLSGILTADDSSTKAPLSASMIQRYNEHQMDLAQLKQFIRQK-LSDKYNEVESDVSK 356
WP_002273241   278 LLAQIGDNYAELFLSAKKLYDSILLSGILTVTDVSTKAPLSASMIQRYNEHQMDLAQLKQFIRQK-LSDKYNEVESDVSK 356
WP_002275430   278 LLTQIGDNYAELFLSAKKLYDSILLSGILTVTDVSTKAPLSASMIQRYNEHQMDLAQLKQFIRQK-LSDKYNEVESDVSK 356
WP_002276448   278 LLAQIGDNYAELFLSAKKLYDSILLSGILTVTDVSTKAPLSASMIQRYNEHQMDLAQLKQFIRQK-LSDKYNEVFSDVSK 356
WP_002277050   278 LLGKIGDDYADLFTLAKNLYDAILLSGILTADDSSTKAPLSASMIKRYAEHHEDLEKLKEFIKAN-KPELYHDIFKDETK 356
WP_002277364   278 LLAQIGDNYAELFLSAKKLYDSILLSGILTVTDVSTKAPLSASMIQRYNEHQMDLAQLKQFIRQK-LSDKYNEVESDVSK 356
WP_002279025   278 LLAQIGDNYAELFLSAKKLYDSILLSGILTADDSSTKAPLSASMIQRYNEHQMDLAQLKQFIRQK-LSDKYNEVFSDVSK 356
WP_002279859   278 LLAQIGDNYAELFLSAKKLYDSILLSGILTVTDVSTKAPLSASMIQRYNEHQMDLAQLKQFIRQK-LSDKYNEVESDVSK 356
WP_002280230   278 LLAQIGDNYAELFLSAKKLYDSILLSGILTVTDVSTKAPLSASMIQRYNEHQMDLAQLKQFIRQK-LSDKYNEVFSDVSK 356
WP_002281696   278 LLAQIGDNYAELFLSAKKLYDSILLSGILTVTDVSTKAPLSASMIQRYNEHQMDLAQLKQFIRQK-LSDKYNEVESDVSK 356
WP_002282247   278 LLGKIGDDYADLFTLAKNLYDAILLSGILTADDSSTKAPLSASMIKRYAEHHEDLEKLKEFIKAN-KPELYHDIFKDETK 356
WP_002282906   278 LLAQIGDNYAELFLSAKKLYDSILLSGILTVTDVGTKAPLSASMIQRYNEHQMDLAQLKQFIRQK-LSDKYNEVESDVSK 356
WP_002283846   278 LLAQIGDNYAELFLSAKKLYDSILLSGILTVTDVSTKAPLSASMIQRYNEHQMDLAQLKQFIRQK-LSDKYNEVESDVSK 356
WP_002287255   278 LLAQIGDNYAELFLSAKKLYDSILLSGILTVTDVSTKAPLSASMIQRYNEHQMDLAQLKQFIRQK-LSDKYNEVESDVSK 356
WP_002288990   278 LLAQIGDNYAELFLSAKKLYDSILLSGILTVTDVSTKAPLSASMIQRYNEHQMDLAQLKQFIRQK-LSDKYNEVESDVSK 356
WP_002289641   278 LLAQIGDNYAELFLSAKKLYDSILLSGILTVTDVSTKAPLSASMIQRYNEHQMDLTQLKQFIRQK-LSDKYNEVFSDVSK 356
WP_002290427   278 LLAQIGDNYAELFLSAKKLYDSILLSGILTVTDVSTKAPLSASMIQRYNEHQMDLAQLKQFIRQK-LSDKYNEVESDVSK 356
WP_002295753   278 LLAQIGDNYAELFLSAKKLYDSILLSGILTVTDVSTKAPLSASMIQRYNEHQMDLAQLKQFIRQK-LSDKYNEVESDVSK 356
WP_002296423   278 LLAQIGDNYAELFLSAKKLYDSILLSGILTVTDVSTKAPLSASMIQRYNEHQMDLAQLKQFIRQK-LSDKYNEVFSDVSK 356
WP_002304487   278 LLGEIGDEYADLFASAKNLYDAILLSGILAVDDNTTKAPLSASMVKRYKEHKEELAAFKRFIKEK-LPKKYEEIFKDDTK 356
WP_002305844   278 LLAQIGDNYAELFLSAKKLYDSILLSGILTVTDVSTKAPLSASMIQRYNEHQMDLAQLKQFIRQK-LSDKYNEVESDVSK 356
WP_002307203   278 LLAQIGDNYAELFLSAKKLYDSILLSGILTVTDVSTKAPLSASMIQRYNEHQMDLAQLKQFIRQK-LSDKYNEVESDVSK 356
```

-continued

```
WP_002310390    278 LLAQIGDNYAELFLSAKKLYDSILLSGILTVTDVSTKAPLSASMIQRYNEHQMDLAQLKQFIRQK-LSDKYNEVESDVSK 356
WP_002352408    278 LLAQIGDNYAELFLSAKKLYDSILLSGILTVTDVSTKAPLSASMIQRYNEHQMDLAQLKQFIRQK-LSDKYNEVESDVSK 356
WP_012997688    278 LLAQIGDNYAELFLSAKKLYDSILLSGILTVTDVSTKAPLSASMIQRYNEHQMDLAQLKQFIRQK-LSDKYNEVESDVSK 356
WP_014677909    278 LLAQIGDNYAELFLSAKKLYDSILLSGILTVTDVSTKAPLSASMIQRYNEHQMDLAQLKQFIRQK-LSDKYNEVESDVSK 356
WP_019312892    278 LLAQIGDNYAELFLSAKKLYDSILLSGILTVTDVSTKAPLSASMIQRYNEHQMDLAQLKQFIRQK-LSDKYNEVESDVSK 356
WP_019313659    278 LLAQIGDNYAELFLSAKKLYDSILLSGILTVTDVGTQAPLSASMIQRYNEHQMDLAQLKQFIRQK-LSDKYNEVFSDVSK 356
WP_019314093    278 LLAQIGDNYAELFLSAKKLYDSILLSGILTVTDVSTKAPLSASMIQRYNEHQMDLAQLKQFIRQK-LSDKYNEVESDVSK 356
WP_019315370    278 LLAQIGDNYAELFLSAKKLYDSILLSGILTVTDVSTKAPLSASMIQRYNEHQMDLTQLKQFIRQK-LSDKYNEVESDVSK 356
WP_019803776    278 LLAQIGDNYAELFLSAKKLYDSILLSGILTVTDVGTKAPLSASMIQRYNEHQMDLAQLKQFIRQK-LSDKYNEVESDVSK 356
WP_019805234    278 LLAQIGDNYAELFLSAKKLYDSILLSGILTVTDVSTKAPLSASMIQRYNEHQMDLAQLKQFIRQK-LSDKYNEVESDVSK 356
WP_024783594    278 LLAQIGDNYAELFLSAKKLYDSILLSGILTVTDVGTKAPLSASMIQRYNEHQMDLAQLKQFIRQK-LSDKYNEVFSDVSK 356
WP_024784288    278 LLGKIGDDYADLFTLAKNLYDAILLSGILTADDSSTKAPLSASMIKRYAEHHEDLEKLKEFIKAN-KPELYHDIFKDETK 356
WP_024784666    278 LLAQIGDNYAELFLSAKKLYDSILLSGILTVTDVSTKAPLSASMIQRYNEHQMDLVQLKQFIRQK-LSDKYNEVESDVSK 356
WP_024784894    278 LLAQIGDNYAELFLSAKKLYDSILLSGILTVTDVSTKAPLSASMIQRYNEHQMDLTQLKQFIRQK-LSDKYNEVESDVSK 356
WP_024786433    278 LLGKIGDDYADLFTLAKNLYDAILLSGILTADDSSTKAPLSASMIKRYAEHHEDLEKLKEFIKAN-KPELYHDIFKDETK 356
WP_049473442    278 LLGKIGDDYADLFTLAKNLYDAILLSGILTADDSSTKAPLSASMIQRYNEHQMDLAQLKQFIRQK-LSDKYNEVESDVSK 356
WP_049474547    278 LLAQIGDNYAELFLSAKKLYDSILLSGILTVTDVSTKAPLSASMIQRYNEHQMDLTQLKQFIRQK-LSDKYNEVESDVSK 356
EMC03581        271 LLAQIGDNYAELFLSAKKLYDSILLSGILTVTDVSTKAPLSASMIQRYNEHQMDLAQLKQFIRQK-LSDKYNEVESDVSK 349
WP_000428612    279 LLGQIGDDFADLFVAAKKLYDAILLSGILTVTDPSTKAPLSASMIERYENHQKDLATLKQFIKTN-LPEKYDEVFSDQSK 357
WP_000428613    279 LLGQIGDDFADLFLVAKKLYDAILLSGILTVTDPSTKAPLSASMIERYENHQKDLAVLKQFIKNN-LPEKYDEVFSDQSK 357
WP_049523028    278 LLGQIGDVYADLFVVAKKLYDAILLAGILSVKDPGTKAPLSASMIERYDNHQNDLSALKQFVRRN-LPEKYAEVFSDDSK 356
WP_003107102    247 LLAQIGDQYADLFIAAKNLSDAILLSDILTVKGVNTKAPLSASMVQRFNEHQDDLKLLKKLVKVQ-LPEKYKEIFDIKDK 325
WP_054279288    280 LLTQIGDEYADLFLSAKNLSDAILLSDILTVNGDGTQAPLSASLIKRYEEHRQDLALLKQMFKEQ-LPDLYRDVFTDENK 358
WP_049531101    279 LLGQIGDDFADLFLVAKKLYDAILLSGILTVTDPSTKAPLSASMIERYENHQKDLAAALKQFIKNN-LPEKYDEVFSDQSK 357
WP_049538452    279 LLGQIGDGFADLFLVAKKLYDAILLSGILTVTDPSTKAPLSASMIERYQNHQNDLASLKQFIKNN-LPEKYDEVFSDQSK 357
WP_049549711    279 LLGQIGDDFADLFLVAKKLYDAILLSGILTVTDPSTKAPLSASMIERYENHQKDLTTLKQFIKNN-LPEKYDEVFSDQSK 357
WP_007896501    280 LLAEIGDHYADLFLAAKNLSDAILLSDILTLSDENTRAPLSASMIKRYEEHQEDLALLKKLVKEQ-MPEKYWEIFSNAKK 358
EFR44625        232 LLAEIGDHYADLFLAAKNLSDAILLSDILTLSDENTRAPLSASMIKRYEEHQEDLALLKKLVKEQ-MPEKYWEIFSNAKK 310
WP_002897477    278 LLGQIGDDFADLFLIAKKLYDAILLSGILTVTDPSTKAPLSASMIERYENHQKDLAALKQFIKNN-LPEKYVEVFSDQSK 356
WP_002906454    278 LLGQIGDGFADLFLVAKKLYDAILLSGILTVTDPSTKAPLSASMIERYENHQEDLAALKQFIKNN-LSEKYAEVFSDQSK 356
WP_009729476    279 LLGQIGDDFADLFLVAKKLYDAILLSGILTVTNPSTKAPLSASMIERYENHQKDLASLKQFIKNN-LPEKYDEVFSDQSE 357
CQR24647        278 LLGIIGDEYADVFVAAKKVYDSILLSGILTTNNHSTKAPLSASMIDRYDEHNSDKKLLRDFIRTNIGKEVFKEVFYDTSK 357
WP_000066813    279 LLGQIGDDFADLFLVAKKLYDAILLSGILTVKDLSTKAPLSASMIERYENHQKDLAALKQFIQNN-LQEKYDEVFSDQSK 357
WP_009754323    279 LLGQIGDDFADLFLVAKKLYDAILLSGILTVTDPSTKAPLSASMIERYENHQEDLAALKQFIKNN-LPEKYAEVFSDQSK 357
WP_044674937    278 LLGKIGDDYADLFIATKSLYDGILLAGILSTTDSTTKAPLSSSMVNRYEEHKKDLALLKNFIHQN-LSDSYKEVENDKLK 356
WP_044676715    278 LLGKIGDDYADLFIATKSLYDGILLAGILSTTDSTTKAPLSSSMVNRYEEHQKDLALLKNFIHQN-LSDSYKEVENDKLK 356
WP_044680361    278 LLGKIGDDYADLFIATKSLYDGILLAGILSTTDSTTKAPLSSSMVNRYEEHQKDLALLKNFIHQN-LSDSYKEVENDKLK 356
WP_044681799    278 LLGKIGDDYADLFIATKSLYDGILLAGILSTTDSTTKAPLSSSMVNRYEEHKKDLALLKNFIHQN-LSDSYKEVENDKLK 356
WP_049533112    278 LLGEIGDEYADLFASAKNLYDAILLSGILTVDDNSTKAPLSASMVKRYEEHQKDLKKLKDFIKVN-APDQYNAIFKDKNK 356
WP_029090905    244 LADVLADEEYDLLLTAQKIYSAIILDESMDGYEYFA-----EAKKESYRKHQEELVLVKKMLKSNaITNDERAKF---EY 315
```

```
WP_006506696  284 VEKDLGE-YVEFVDALHNVYSWVELQTIMGATHTD-NASISEAMVSRYNKIHDDLKLLKDCIKNN-VPNKYFDMERNDSE 360

AIT42264      278 LLAQIGDQYADLFLAAKNLSDAILLSDILRVNTEITKAPLSASMIKRYDEHHQDLTLLKALVRQQ-LPEKYKEIFFDQSK 356

WP_034440723  284 LLSNIDEGYRDVFLQAKNVYNAIELSKILKTDGKETKAPLSAQMVELYNQHREDLKKYKDYIKAY-LPEKYGETFKDATK 362

AKQ21048      278 LLAQIGDQYADLFLAAKNLSDAILLSDILRVNTEITKAPLSASMIKRYDEHHQDLTLLKALVRQQ-LPEKYKEIFFDQSK 356

WP_004636532  277 LLGMTDDVFLDVFMAAKNVYDAVEMSAIISTDTGNSKAVLSNQMINFYDEHKVDLAQLKQFFKTH-LPDKYYECFSDPSK 355

WP_002364836  284 ILAKVGDEYSDVFLAAKNVYDAVELSTILADSDKKSHAKLSSSMIVRFTEHQEDLKKFKRFIREN-CPDEYDNLFKNEQK 362

WP_016631044  235 ILAKVGDEYSDVFLAAKNVYDAVELSTILADSDKKSHAKLSSSMIVRFTEHQEDLKKFKRFIREN-CPDEYDNLFKNEQK 313

EMS75795       21 LLEKSGEEFRDVFLQAKKVYDAILLSDILSTKKQNSKAKLSLGMIERYDSHKKDLEELKQFVKAN-LPEKTAIFFKDSSK  99

WP_002373311  284 ILAKVGDEYSDVFLAAKNVYDAVELSTILADSDKKSHAKLSSSMIVRFTEHQEDLKKEKRFIREN-CPDEYDNLFKNEQK 362

WP_002378009  284 ILAKVGDEYSDVFLAAKNVYDAVELSTILADSDKKSHAKLSSSMIVRFTEHQEDLKNFKRFIREN-CPDEYDNLFKNEQK 362

WP_002407324  284 ILAKVGDEYSDVFLAAKNVYDAVELSTILADSDKKSHAKLSSSMIVRFTEHQEDLKNFKRFIREN-CPDEYDNLFKNEQK 362

WP_002413717  284 ILAKVGDEYSDVFLAAKNVYDAVELSTILADSDKKSHAKLSSSMIVRFTEHQEDLKKFKRFIREN-CPDEYDNLFKNEQK 362

WP_010775580  286 ILAKVGDEYSDVFLAAKNVYDAVELSTILADSDKKSHAKLSSSMIVRFTEHQEDLKNFKRFIREN-CPDEYDNLFKNEQK 364

WP_010818269  284 ILAKVGDEYSDVFLAAKNVYDAVELSTILADSDKKSHAKLSSSMIVRFTEHQEDLKKFKRFIREN-CPDEYDNLFKNEQK 362

WP_010824395  284 ILAKVGDEYSDVFLAAKNVYDAVELSTILADSDKKSHAKLSSSMIVRFTEHQEDLKNFKRFIREN-CPDEYDNLFKNEQK 362

WP_016622645  284 ILAKVGDEYSDVFLAAKNVYDAVELSTILADSDKKSYAKLSSSMIVRFTEHQEDLKKFKRFIREN-CPDEYDNLFKNEQK 362

WP_033624816  284 ILAKVGDEYSDVFLAAKNVYDAVELSTILADSDKKSHAKLSSSMIVRFTEHQEDLKNFKRFIREN-CPDEYDNLFKNEQK 362

WP_033625576  284 ILAKVGDEYSDVFLAAKNVYDAVELSTILADSDKKSHAKLSSSMIVRFTEHQEDLKKFKRFIREN-CPDEYDNLFKNEQK 362

WP_033789179  284 ILAKVGDEYSDVFLAAKNVYDAVELSTILADSDKKSHAKLSSSMIVRFTEHQEDLKNFKRFIREN-CPDEYDNLFKNEQK 362

WP_002310644  282 LLEKIGDDYIDLFVQAKNVYDAVLLSEILSDSTKNTRAKLSAGMIRRYDAHKEDLVLLKRFVKEN-LPKKYRAFFGDNSV 360

WP_002312694  283 LLEKIGDDYIDLFVQAKNVYDAVLLSEILSDSTKNTRAKLSAGMIRRYDAHKEDLVLLKRFVKEN-LPKKYRAFFGDNSV 361

WP_002314015  283 LLEKIGDDYIDLFVQAKNVYDAVLLSEILSDSTKNTRAKLSAGMIRRYDAHKEDLVLLKRFVKEN-LPKKYRAFFGDNSV 361

WP_002320716  283 LLEKIGDDYIDLFVQAKNVYDAVLLSEILSDSTKNTRAKLSAGMIRRYDAHKEDLVLLKRFVKEN-LPKKYRAFFGDNSV 361

WP_002330729  282 LLEKIGDDYIDLFVQAKNVYDAVLLSEILSDSTKNTRAKLSAGMIRRYDAHKEDLVLLKRFVKEN-LPKKYRAFFGDNSV 360

WP_002335161  283 LLEKIGDDYIDLFVQAKNVYDAVLLSEILSDSTKNTRAKLSAGMIRRYDAHKEDLVLLKRFVKEN-LPKKYRAFFGDNSV 361

WP_002345439  283 LLEKIGDDYIDLFVQAKNVYDAVLLSEILSDSTKNTRAKLSAGMIRRYDAHKEDLVLLKRFVKEN-LPKKYRAFFGDNSV 361

WP_034867970  276 LLEKIGDEYLDIFLQAKKVHDAILLSEIISSTVKHTKAKLSSGMVERYERHKADLAKFKQFVKEN-VPQKATVFFKDTTK 354

WP_047937432  283 LLEKIGDDYIDLFVQAKNVYDAVLLSEILSDSTKNTRAKLSAGMIRRYDAHKEDLVLLKRFVKEN-LPKKYRAFFGDNSV 361

WP_010720994  276 LLEKIGDEYLDIFLQAKKVHDAILLSEIISSTVKHTQAKLSSGMVERYERHKADLAKFKQFVKEN-VPQKATVFFKDTTK 354

WP_010737004  276 LLEKIGDEYLDIFLQAKKVHDAILLSEIISSTVKHTKAKLSSGMVERYERHKADLAKFKQFVKEN-VPQKATVFFKDTTK 354

WP_034700478  276 LLEKIGDEYLDIFLQAKKVHDAILLSEIISSTVKHTQAKLSSGMVERYERHKADLAKFKQFVKEN-VPQKATVFFKDTTK 354

WP_007209003  281 LLAIIGDEYGDIFVAAQNLYQAILLAGILTSTEK-TRAKLSASMIQRYEEHAKDLKLLKRFVKEH-IPDKYAEIFNDATK 358

WP_023519017  276 LLEKTSDDYAELFLKAKGVYDAILLSQILSKSDDETKAKLSANMKLRFEEHQRDLKQLKELVRRD-LPKKYDDFFKNRSK 354

WP_010770040  279 LLAIIGDEYAEIFSATKSVYDAVALSGILSVTDGDTKAKLSASMVERYEAHQKDLVQFKQFIRKE-LPEMYAPIFRDNSV 357

WP_048604708  275 LLGEIGDEYADVFEAAKNVYNAVELSGILTVTDNSTKAKLSASMIKRYEDHKTDLKLFKEFIRKN-LPEKYHEIFNDKNT 353

WP_010750235  276 LLRKSNEEMIDVFLQVKKVYDAILLSDILSTKMKDTKAKLSAGMIERYQNHKKDLEELKQFVRAH-LHEKVTVFFKDSSK 354

AII16583      317 LLAQIGDQYADLFLAAKNLSDAILLSDILRVNTEITKAPLSASMIKRYDEHHQDLTLLKALVRQQ-LPEKYKEIFFDQSK 395

WP_029073316  290 KQPLLGD-CVEFIDLLHDIYSWVELQNILGSAHTS-EPSISAAMIQRYEDHKNDLKLLKDVIRKY-LPKKYFEVERDEKS 366

WP_031589969  290 KQPLLGD-CVEFIDLLHDIYSWVELQNILGSAHTS-EPSISAAMIQRYEDHKNDLKLLKDVIRKY-LPKKYFEVERDEKS 366

KDA45870      276 LLAEAGDQYLDIFVAAKKVYDAAILASILDVKDTQTKTVFSQAMIERYEEHQKDLIELKRVFKKY-LPEKCHDFFSE-PK 353

WP_039099354  286 LESSLDDNAHQIIESLQELYSGVLLAGIVPENQSLS-----QAMITKYDDHQKHLKMLKAVREAL-APEDRQRLKQAYDQ 359
```

-continued

```
AKP02966        279  LDSILDDDQFTVLDTANRIYSTITLNEIL-----NGESYFSMAKVNQYENHAIDLCKLRDMWHTT----KNEKAV-GLSR  348
WP_010991369    284  LLALIGDEYAELFVAAKNAYSAVVLSSIITVAETETNAKLSASMIERFDTHEEDLGELKAFIKLH-LPKHYEEIFSNTEK  362
WP_033838504    284  LLALIGDEYAELFVAAKNAYSAVVLSSIITVAETETNAKLSASMIERFDTHEEDLGELKAFIKLH-LPKHYEEIFSNTEK  362
EHN60060        287  LLALIGDEYAELFVAAKNAYSAVVLSSIITVAETETNAKLSASMIERFDTHEEDLGELKAFIKLH-LPKHYEEIFSNTEK  365
EFR89594         53  LLALIGDEYAELFVAAKNAYSAVVLSSIITVAETETNAKLSASMIERFDTHEEDLGELKAFIKLH-LPKHYEEIFSNTEK  131
WP_038409211    284  LLAKIGDEYAEIFVAAKSTYNAVVLSNIITVTDTETKAKLSASMIERFDKHAKDLKRLKAFFKMQ-LPEKFNEVENDIEK  362
EFR95520             ------------------------------------------------------------------------------
WP_003723650    284  LLAIIGDEYAELFVAAKNTYNAVVLSSIITVTDTETNAKLSASMIERFDAHEKDLVELKAFIKLN-LPKQYEEIFSNAAI  362
WP_003727705    284  LLAIIGDEYAELFVAAKNTYNAVVLSSIITVTATETNAKLSASMIERFDAHEKELGELKAFIKLH-LPKQYQEIFNNAEI  362
WP_003730785    284  LLAIIGDEYAELFVAAKNTYNAVVLSSIITVTATETNAKLSASMIERFDAHEKELGELKAFIKLH-LPKQYQEIFNNAEI  362
WP_003733029    284  LLAIIGDEFAEVFVAAKNAYNAVVLSNIITVIDSTTRAKLSASLIERFENHKEDLKKMKRFVRTY-LPEKYDEIFDDTEK  362
WP_003739838    284  LLAIIGDEYAELFVAAKNTYNAVVLSSIITVTDTETNAKLSASMIERFDAHEKDLSELKAFIKLH-LPKQYEEIFSNVAI  362
WP_014601172    284  LLAIIGDEYAELFVAAKNTYNAVVLSSIITVTATETNAKLSASMIERFDAHEKDLGELKAFIKLH-LPKQYQEIFNNAAI  362
WP_023548323    284  LLAIIGDEYAELFVAAKNTYNAVVLSSIITVTDTETNAKLSASMIERFDAHEKDLVELKAFIKLN-LPKQYEEIFSNAAI  362
WP_031665337    284  LLAIIGDEYAELFVAAKNTYNAVVLSSIITVNDTETNAKLSASMIERFDAHEKDLVELKAFIKLN-LPKQYEEIFSNAAI  362
WP_031669209    284  LLAIIGDEFAEVFVAAKNAYNAVVLSNIITVIDSTTRAKLSASLIERFENHKEDLKKMKRFVRTY-LPEKYDEIFDDTEK  362
WP_033920898    284  LLAIIGDEYAELFVAAKNTYNAVVLSSIITVTDTETNAKLSASMIERFDAHEKDLVELKAFIKLN-LPKQYEEIFSNAAI  362
AKI42028        287  LLAIIGDEYAELFVAAKNTYNAVVLSSIITVTATETNAKLSASMIERFDAHEKDLGELKAFIKLH-LPKQYQEIFNNAAI  365
AKI50529        287  LLAIIGDEYAELFVAAKNTYNAVVLSSIITVTDTETNAKLSASMIERFDAHEKDLVELKAFIKLN-LPKQYEEIFSNAAI  365
EFR83390             ------------------------------------------------------------------------------
WP_046323366    284  LLARVGDEYAEIFVAAKNAYNAVVLSSIITVSNTETKAKLSASMIERFDKHDKDLKRMKAFFKVR-LPENFNEVENDVEK  362
AKE81011        294  LLAQIGDQYADLFLAAKNLSDAILLSDILRVNTEITKAPLSASMIKRYDEHHQDLTLLKALVRQQ-LPEKYKEIFFDQSK  372
CUO82355        288  VENDLGE-YVEFIDSLHNIYSWVELQTIMGATHTD-NASISEAMVSRYNKIHEDLQLLKKCIKDN-VPKKYFDMERNDSE  364
WP_033162887    289  LQSELGE-YIEFIEMLHNIYSWVELQAILGATHTD-NPSISAAMVERYEEHKKDLRVLKKVIREE-LPDKYNEVERKDNR  365
AGZ01981        311  LLAQIGDQYADLFLAAKNLSDAILLSDILRVNTEITKAPLSASMIKRYDEHHQDLTLLKALVRQQ-LPEKYKEIFFDQSK  389
AKA60242        278  LLAQIGDQYADLFLAAKNLSDAILLSDILRVNTEITKAPLSASMIKRYDEHHQDLTLLKALVRQQ-LPEKYKEIFFDQSK  356
AKS40380        278  LLAQIGDQYADLFLAAKNLSDAILLSDILRVNTEITKAPLSASMIKRYDEHHQDLTLLKALVRQQ-LPEKYKEIFFDQSK  356
4UN5_B          282  LLAQIGDQYADLFLAAKNLSDAILLSDILRVNTEITKAPLSASMIKRYDEHHQDLTLLKALVRQQ-LPEKYKEIFFDQSK  360
WP_010922251    357  --NGYAG YIDG G ASQEEFYKFIKPILEK-M--DGTEELLv--KLNREDLLRKQRTFDNG[S]IPHQIHLGEL         419
WP_039695303    358  --NGYAG YIEN G VKQDEFYKYLKNILSK-IkiDGSDYFL--DKIEREDFLRKQRTFDNGSIPHQIHLQEM          422
WP_045635197    357  --DGYAG YIDG K TTQETFYKYIKNLLSK-F--EGTDYFL--DKIEREDFLRKQRTFDNGSIPHQIHLQEM          419
5AXW_A          169  ------G SINR - ---------------K------TSDYVk----------------------------EA         183
WP_009880683     41  --NGYAG YIDG G ASQEEFYKFIKPILEK-M--DGTEELLa--KLNREDLLRKQRTFDNGSIPHQIHLGEL          103
WP_010922251    357  --NGYAG YIDG G ASQEEFYKFIKPILEK-M--DGTEELLv--KLNREDLLRKQRTFDNGSIPHQIHLGEL          419
WP_011054416    357  --NGYAG YIDG G ASQEEFYKFIKPILEK-M--DGTEELLa--KLNREDLLRKQRTEDNGSIPYQIHLGEL          419
WP_011284745    357  --NGYAG YIDG G ASQEEFYKFIKPILEK-M--DGTEELLa--KLNREDLLRKQRTFDNGSIPHQIHLGEL          419
WP_011285506    357  --NGYAG YIDG G ASQEEFYKFIKPILEK-M--DGTEELLv--KLNREDLLRKQRTFDNGSIPHQIHLGEL          419
WP_011527619    357  --NGYAG YIDG G ASQEEFYKFIKPILEK-M--DGTEELLa--KLNREDLLRKQRTFDNGSIPHQIHLGEL          419
WP_012560673    357  --NGYAG YIDG G ASQEEFYKFIKPILEK-M--DGTEELLa--KLNREDLLRKQRTFDNGSIPHQIHLGEL          419
WP_014407541    357  --NGYAG YIDG G ASQEEFYKFIKPILEK-M--DGTEELLv--KLNREDLLRKQRTFDNGSIPHQIHLGEL          419
```

-continued

| | | | |
|---|---|---|---|
| WP_020905136 | 357 | --NGYAG YIDG G ASQEEFYKFIKPILEK-M--DGTEELLa--KLNREDLLRKQRTFDNGSIPHQIHLGEL | 419 |
| WP_023080005 | 357 | --NGYAG YIDG G ASQEEFYKFIKPILEK-M--DGTEELLa--KLNREDLLRKQRTFDNGSIPYQIHLGEL | 419 |
| WP_023610282 | 357 | --NGYAG YIDG G ASQEEFYKFIKPILEK-M--DGTEELLa--KLNREDLLRKQRTFDNGSIPYQIHLGEL | 419 |
| WP_030125963 | 357 | --NGYAG YIDG G ASQEEFYKFIKPILEK-M--DGTEELLv--KLNREDLLRKQRTFDNGSIPHQIHLGEL | 419 |
| WP_030126706 | 357 | --NGYAG YIDG G ASQEEFYKFIKPILEK-M--DGTEELLv--KLNREDLLRKQRTFDNGSIPYQIHLGEL | 419 |
| WP_031488318 | 357 | --NGYAG YIDG G ASQEEFYKFIKPILEK-M--DGTEELLa--KLNREDLLRKQRTFDNGSIPHQIHLGEL | 419 |
| WP_032460140 | 357 | --NGYAG YIDG G ASQEEFYKFIKPILEK-M--DGTEELLa--KLNREDLLRKQRTFDNGSIPHQIHLGEL | 419 |
| WP_032461047 | 357 | --NGYAG YIDG G ASQEEFYKFIKPILEK-M--DGTEELLa--KLNREDLLRKQRTFDNGSIPHQIHLGEL | 419 |
| WP_032462016 | 357 | --NGYAG YIDG G ASQEEFYKFIKPILEK-M--DGTEELLv--KLNREDLLRKQRTFDNGSIPHQIHLGEL | 419 |
| WP_032462936 | 357 | --NGYAG YIDG G ASQEEFYKFIKPILEK-M--DGTEELLa--KLNREDLLRKQRTFDNGSIPHQIHLGEL | 419 |
| WP_032464890 | 357 | --NGYAG YIDG G ASQEEFYKFIKPILEK-M--DGTEELLa--KLNRKDLLRKQRTFDNGSIPHQIHLGEL | 419 |
| WP_033888930 | 182 | --NGYAG YIDG G ASQEEFYKFIKPILEK-M--DGTEELLv--KLNREDLLRKQRTFDNGSIPHQIHLGEL | 244 |
| WP_038431314 | 357 | --NGYAG YIDG G ASQEEFYKFIKPILEK-M--DGTEELLa--KLNREDLLRKQRTFDNGSIPHQIHLGEL | 419 |
| WP_038432938 | 357 | --NGYAG YIDG G ASQEEFYKFIKPILEK-M--DGTEELLa--KLNREDLLRKQRTFDNGSIPYQIHLGEL | 419 |
| WP_038434062 | 357 | --NGYAG YIDG G ASQEEFYKFIKPILEK-M--DGTEELLa--KLNREDLLRKQRTFDNGSIPHQIHLGEL | 419 |
| BAQ51233 | 268 | --NGYAG YIDG G ASQEEFYKFIKPILEK-M--DGTEELLv--KLNREDLLRKQRTEDNGSIPHQIHLGEL | 330 |
| KGE60162 | | ------- ---- - ---------------------------------------------------------- | |
| KGE60856 | | ------- ---- - ---------------------------------------------------------- | |
| WP_002989955 | 357 | --NGYAG YIDG G ASQEEFYKFIKPILEK-M--DGTEELLa--KLNREDLLRKQRTEDNGSIPHQIHLGEL | 419 |
| WP_003030002 | 357 | --KGYAG YIEN G VKQDEFYKYLKGILLQ-I--NGSGDFL--DKIDREDFLRKQRTFDNGSIPHQIHLQEM | 419 |
| WP_003065552 | 360 | --NGYAG YIEN G VKQDEFYKYLKNTLSK-Ia--GSDYFL--DKIEREDFLRKQRTFDNGSIPHQIHLQEM | 422 |
| WP_001040076 | 358 | --DGYAG YIEG K TNQEAFYKYLSKLLTK-Q--EGSEYFL--EKIKNEDFLRKQRTFDNGSIPHQVHLTEL | 420 |
| WP_001040078 | 358 | --DGYAG YIEG K TNQEAFYKYLSKLLTK-Q--EDSENFL--EKIKNEDFLRKQRTFDNGSIPHQVHLTEL | 420 |
| WP_001040080 | 358 | --DGYAG YIEG K TNQEAFYKYLSKLLTK-Q--EDSENFL--EKIKNEDFLRKQRTFDNGSIPHQVHLTEL | 420 |
| WP_001040081 | 358 | --DGYAG YIEG K TNQEAFYKYLSKLLTK-Q--EDSENFL--EKIKNEDFLRKQRTFDNGSIPHQVHLTEL | 420 |
| WP_001040083 | 358 | --DGYAG YIEG K TNQEAFYKYLSKLLTK-Q--EDSENFL--EKIKNEDFLRKQRTFDNGSIPHQVHLTEL | 420 |
| WP_001040085 | 358 | --DGYAG YIEG K TNQEAFYKYLSKLLTK-Q--EDSENFL--EKIKNEDFLRKQRTFDNGSIPHQVHLTEL | 420 |
| WP_001040087 | 358 | --DGYAG YIEG K TNQEAFYKYLSKLLTK-Q--EDSENFL--EKIKNEDFLRKQRTFDNGSIPHQVHLTEL | 420 |
| WP_001040088 | 358 | --DGYAG YIEG K TNQEAFYKYLSKLLTK-Q--EDSENFL--EKIKNEDFLRKQRTFDNGSIPHQVHLTEL | 420 |
| WP_001040089 | 358 | --DGYAG YIEG K TNQEAFYKYLSKLLTK-Q--EDSENFL--EKIKNEDFLRKQRTFDNGSIPHQVHLTEL | 420 |
| WP_001040090 | 358 | --DGYAG YIEG K TNQEAFYKYLSKLLTK-Q--EDSENFL--EKIKNEDFLRKQRTFDNGSIPHQVHLTEL | 420 |
| WP_001040091 | 358 | --DGYAG YIEG K TNQEAFYKYLSKLLTK-Q--EDSENFL--EKIKNEDFLRKQRTFDNGSIPHQVHLTEL | 420 |
| WP_001040092 | 358 | --DGYAG YIEG K TNQEAFYKYLSKLLTK-Q--EDSEYFL--EKIKNEDFLRKQRTFDNGSIPHQVHLTEL | 420 |
| WP_001040094 | 358 | --DGYAG YIEG K TNQEAFYKYLSKLLTK-Q--EGSEYLL--EKIKNEDFLRKQRTFDNGSIPHQVHLTEL | 420 |
| WP_001040095 | 358 | --DGYAG YIEG K TNQEAFYKYLSKLLTK-Q--EGSEYLL--EKIKNEDFLRKQRTFDNGSIPHQVHLTEL | 420 |
| WP_001040096 | 358 | --DGYAG YIEG K TNQEAFYKYLSKLLTK-Q--EGSEYLL--EKIKNEDFLRKQRTEDNGSIPHQVHLTEL | 420 |
| WP_001040097 | 358 | --DGYAG YIEG K TNQEAFYKYLSKLLTK-Q--EGSEYLL--EKIKNEDFLRKQRTFDNGSIPHQVHLTEL | 420 |
| WP_001040098 | 358 | --DGYAG YIEG K TNQEAFYKYLSKLLTK-Q--EGSEYLL--EKIKNEDFLRKQRTFDNGSIPHQVHLTEL | 420 |
| WP_001040099 | 358 | --DGYAG YIEG K TNQEAFYKYLSKLLTK-Q--EGSEYLL--EKIKNEDFLRKQRTEDNGSIPHQVHLTEL | 420 |
| WP_001040100 | 358 | --DGYAG YIEG K TNQEAFYKYLSKLLTK-Q--EGSEYLL--EKIKNEDFLRKQRTFDNGSIPHQVHLTEL | 420 |

-continued

```
WP_001040104    358  --DGYAG YIEG K TNQEAFYKYLSKLLLTK-Q--EDSENFL--EKIKNEDFLRKQRTFDNGSIPHQVHLTEL    420

WP_001040105    358  --DGYAG YIEG K TNQEAFYKYLSKLLLTK-Q--EDSENFL--EKIKNEDFLRKQRTFDNGSIPHQVHLTEL    420

WP_001040106    358  --DGYAG YIEG K TNQGAFYKYLSKLLLTK-Q--EGSEYFL--EKIKNEDFLRKQRTFDNGSIPHQVHLTEL    420

WP_001040107    358  --DGYAG YIEG K TNQEAFYKYLSKLLLTK-Q--EGSEYFL--EKIKNEDFLRKQRTFDNGSIPHQVHLTEL    420

WP_001040108    358  --DGYAG YIEG K TNQGAFYKYLSKLLLTK-Q--EGSEYFL--EKIKNEDFLRKQRTFDNGSIPHQVHLTEL    420

WP_001040109    358  --DGYAG YIEG K TNQEAFYKYLSKLLLTK-Q--EGSEYFL--EKIKNEDFLRKQRTFDNGSIPHQVHLTEL    420

WP_001040110    358  --DGYAG YIEG K TNQEAFYKYLSKLLLTK-Q--EGSEYFL--EKIKNEDFLRKQRTFDNGSIPHQVHLTEL    420

WP_015058523    358  --DGYAG YIEG K TNQEAFYKYLSKLLLTK-Q--EDSEYFL--EKIKNEDFLRKQRTEDNGSIPHQVHLTEL    420

WP_017643650    358  --DGYAG YIEG K TNQEAFYKYLSKLLLTK-Q--EGSEYLL--EKIKNEDFLRKQRTFDNGSIPHQVHLTEL    420

WP_017647151    358  --DGYAG YIEG K TNQGAFYKYLSKLLLTK-Q--EGSEYFL--EKIKNEDFLRKQRTFDNGSIPHQVHLTEL    420

WP_017648376    358  --DGYAG YIEG K TNQGAFYKYLSKLLLTK-Q--EGSEYFL--EKIKNEDFLRKQRTFDNGSIPHQVHLTEL    420

WP_017649527    358  --DGYAG YIEG K TNQEAFYKYLSKLLLTK-Q--EDSENFL--EKIKNEDFLRKQRTEDNGSIPHQVHLTEL    420

WP_017771611    358  --DGYAG YIEG K TNQGAFYKYLSKLLLTK-Q--EGSEYFL--EKIKNEDFLRKQRTFDNGSIPHQVHLTEL    420

WP_017771984    358  --DGYAG YIEG K TNQEAFYKYLSKLLLTK-Q--EDSENFL--EKIKNEDFLRKQRTFDNGSIPHQVHLTEL    420

CFQ25032        358  --DGYAG YIEG K TNQEAFYKYLSKLLLTK-Q--EDSENFL--EKIKNEDFLRKQRTFDNGSIPHQVHLTEL    420

CFV16040        358  --DGYAG YIEG K TNQEAFYKYLSKLLLTK-Q--EDSENFL--EKIKNEDFLRKQRTFDNGSIPHQVHLTEL    420

KLJ37842        358  --DGYAG YIEG K TNQEAFYKYLSKLLLTK-Q--EDSENFL--EKIKNEDFLRKQRTEDNGSIPHQVHLTEL    420

KLJ72361        358  --DGYAG YIEG K TNQEAFYKYLSKLLLTK-Q--EDSENFL--EKIKNEDFLRKQRTFDNGSIPHQVHLTEL    420

KLL20707        358  --DGYAG YIEG K TNQEAFYKYLSKLLLTK-Q--EDSENFL--EKIKNEDFLRKQRTFDNGSIPHQVHLTEL    420

KLL42645        358  --DGYAG YIEG K TNQGAFYKYLSKLLLTK-Q--EGSEYFL--EKIKNEDFLRKQRTFDNGSIPHQVHLTEL    420

WP_047207273    358  --DGYAG YIEG K TNQEAFYKYLSKLLLTK-Q--EDSENFL--EKIKNEDFLRKQRTFDNGSIPHQVHLTEL    420

WP_047209694    358  --DGYAG YIEG K TNQEAFYKYLSKLLLTK-Q--EGSEYLL--EKIKNEDFLRKQRTFDNGSIPHQVHLTEL    420

WP_050198062    358  --DGYAG YIEG K TNQEAFYKYLSKLLLTK-Q--EDSENFL--EKIKNEDFLRKQRTFDNGSIPHQVHLTEL    420

WP_050201642    358  --DGYAG YIEG K TNQEAFYKYLSKLLLTK-Q--EDSENFL--EKIKNEDFLRKQRTFDNGSIPHQVHLTEL    420

WP_050204027    358  --DGYAG YIES K TNQGAFYKYLSKLLLTK-Q--EGSEYFL--EKIKNEDFLRKQRTFDNGSIPHQVHLTEL    420

WP_050881965    358  --DGYAG YIEG K TNQEAFYKYLSKLLLTK-Q--EDSENFL--EKIKNEDFLRKQRTFDNGSIPHQVHLTEL    420

WP_050886065    358  --DGYAG YIEG K TNQEAFYKYLSKLLLTK-Q--EDSENFL--EKIKNEDFLRKQRTFDNGSIPHQVHLTEL    420

AHN30376        358  --DGYAG YIEG K TNQEAFYKYLSKLLLTK-Q--EDSEYFL--EKIKNEDFLRKQRTEDNGSIPHQVHLTEL    420

EAO78426        358  --DGYAG YIEG K TNQEAFYKYLSKLLLTK-Q--EDSENFL--EKIKNEDFLRKQRTFDNGSIPHQVHLTEL    420

CCW42055        358  --DGYAG YIEG K TNQEAFYKYLSKLLLTK-Q--EGSEYLL--EKIKNEDFLRKQRTFDNGSIPHQVHLTEL    420

WP_003041502    357  --KGYAG YIES G VKQDEFYKYLKGILLQ-I--NGSGDFL--DKIDREDFLRKQRTFDNGSIPHQIHLQEM    419

WP_037593752    358  --KGYAG YIES G VEQDEFYKYLKGILLK-I--NGSGDFL--DKIDCEDFLRKQRTFDNGSIPHQIHLQEM    420

WP_049516684    358  --NGYAG YIEN G VKQDEFYKYLKNTLSK-I--DGSDYFL--DKIDREDFLRKQRTFDNGSIPHQIHLQEM    420

GAD46167        357  --KGYAG YIES G VEQDEFYKYLKGILLK-I--NGSGDFL--DKIDCEDFLRKQRTFDNGSIPHQIHLQEM    419

WP_018363470    358  --NGYAG YIEN G VKQDEFYKYLKGILTK-I--NGSDYFL--DKIEREDFLRKQRTFDNGSIPHQIHLQEM    420

WP_003043819    357  --NGYAG YVGI G ATQEEFYKFIKPILEK-M--DGAEELLa--KLNRDDLLRKQRTFDNGSIPHQIHLKEL    429

WP_006269658    357  --KGYAS YIES G VKQDEFYKYLKGILLK-I--NGSGDFL--DKIDREDFLRKQRTFDNGSIPHQIHLQEM    419

WP_048800889    357  --NGYAG YIEN G VKQDEFYKYLKNTLSK-I--DGSGYFL--DKIEREDFLRKQRTFDNGSIPHQIHLQEM    419

WP_012767106    357  --NGYAG YIDG G ASQEEFYKFIKPILEK-M--DGTEELLa--KLNREDLLRKQRTEDNGSIPHQIHLGEL    419

WP_014612333    357  --NGYAG YIDG G ASQEEFYKFIKPILEK-M--DGTEELLa--KLNREDLLRKQRTEDNGSIPHQIHLGEL    419

WP_015017095    357  --NGYAG YIDG G ASQEEFYKFIKPILEK-M--DGTEELLa--KLNREDLLRKQRTEDNGSIPHQIHLGEL    419
```

-continued

| | | |
|---|---|---|
| WP_015057649 | 357 --NGYAG YIDG G ASQEEFYKFIKPILEK-M--DGTEELLa--KLNREDLLRKQRTFDNGSIPHQIHLGEL | 419 |
| WP_048327215 | 357 --NGYAG YIDG G ASQEEFYKFIKPILEK-M--DGTEELLa--KLNREDLLRKQRTFDNGSIPHQIHLGEL | 419 |
| WP_049519324 | 357 --NGYAG YIDG G ASQEEFYKFIKPILEK-M--DGTEELLa--KLNREDLLRKQRTFDNGSIPHQIHLGEL | 419 |
| WP_012515931 | 357 --NGYAG YIEG Q VSQEEFYKYLKPILAR-L--DGSEPLLl--KIDREDFLRKQRTFDNGSIPHQIHLEEL | 419 |
| WP_021320964 | 357 --NGYAG YIEG Q VSQEEFYKYLKPILAR-L--DGSEPLLl--KIDREDFLRKQRTFDNGSIPHQIHLEEL | 419 |
| WP_037581760 | 357 --NGYAG YIEG Q VSQEEFYKYLKPILAR-L--DGSEPLLl--KIDREDFLRKQRTFDNGSIPHQIHLEEL | 419 |
| WP_004232481 | 357 --NGYAG YIEN G VKQDIFYKHLKSIISE-K--NGGQYFL--DKIEREDFLRKQRTFDNGSIPYQIHLQEM | 419 |
| WP_009854540 | 358 --NGYAG YIEN G VKQDEFYKYLKNTLSK-I--DGSDYFL--DKIEREDFLRKQRTFDNGSIPHQIHLQEM | 420 |
| WP_012962174 | 358 --NGYAG YIEN G VKQDEFYKYLKTTLSK-I--DGSDYFL--DKIEREDFLRKQRTFDNGSIPHQIHLQEM | 420 |
| WP_039695303 | 358 --NGYAG YIEN G VKQDEFYKYLKNILSK-IkiDGSDYFL--DKIEREDFLRKQRTFDNGSIPHQIHLQEM | 422 |
| WP_014334983 | 357 --NGYAG YIDN G VKQDEFYKYLKTILTK-I--DDSDYFL--DKIERDDFLRKQRTFDNGSIPHQIHLQEM | 419 |
| WP_003099269 | 357 --NGYAG YIDG K TSQEEFYKYIKPILLK-L--DGTEKLIs--KLEREDFLRKQRTFDNGSIPHQIHLNEL | 419 |
| AHY15608 | 357 --NGYAG YIDG K TSQEEFYKYIKPILLK-L--DGTEKLIs--KLEREDFLRKQRTFDNGSIPHQIHLNEL | 419 |
| AHY17476 | 357 --NGYAG YIDG K TSQEEFYKYIKPILLK-L--DGTEKLIs--KLEREDFLRKQRTFDNGSIPHQIHLNEL | 419 |
| ESR09100 | ------- ---- - -------------------------------------------------------- | |
| AGM98575 | 357 --NGYAG YIDG K TSQEEFYKYIKPILLK-L--DGTEKLIs--KLEREDFLRKQRTFDNGSIPHQIHLNEL | 419 |
| ALF27331 | 357 --DGYAG YIDG K TNQEAFYKYLKGLLNK-I--EGSGYFL--DKIEREDFLRKQRTFDNGSIPHQIHLQEM | 419 |
| WP_018372492 | 355 --PSYAA YVSG A VTEDDFYKFSKGLLID-V--EGAEYFL--EKIEREDFLRKQRTFDNGAIPNQVHVKEL | 432 |
| WP_045618028 | 358 --DGYAG YIDG K TTQEAFYKYIKNLLSK-L--EGADYFL--DKIEREDFLRKQRTFDNGSIPHQIHLQEM | 420 |
| WP_045635197 | 357 --DGYAG YIDG K TTQETFYKYIKNLLSK-F--EGTDYFL--DKIEREDFLRKQRTFDNGSIPHQIHLQEM | 419 |
| WP_002263549 | 357 --DGYAG YIDG K TNQEAFYKYLKGLLNK-I--EGSGYFL--DKIEREDFLRKQRTFDNGSIPHQIHLQEM | 419 |
| WP_002263887 | 357 --DGYAG YIDG K TNQEAFYKYLKGLLNK-I--EGSGYFL--DKIEREDFLRKQRTFDNGSIPHQIHLQEM | 419 |
| WP_002264920 | 357 --NGYAG YIEN G VKQDEFYKYLKNTLSK-I--AGSDYFL--DKIEREDFLRKQRTFDNGSIPHQIHLQEM | 419 |
| WP_002269043 | 357 --DGYAG YIDG K TNQEAFYKYLKGLLNK-I--EGSGYFL--DKIEREDFLRKQRTFDNGSIPHQIHLQEM | 419 |
| WP_002269448 | 357 --DGYAG YIDG K TNQEAFYKYLKGLLNK-I--EGSGYFL--DKIEREDFLRKQRTFDNGSIPHQIHLQEM | 419 |
| WP_002271977 | 357 --DGYAG YIDG K TNQEAFYKYLKGLLNK-I--EGSGYFL--DKIEREDFLRKQRTFDNGSIPHQIHLQEM | 419 |
| WP_002272766 | 357 --DGYAG YIDG K TNQEAFYKYLKGLLNK-I--EGSGYFL--DKIEREDFLRKQRTFDNGSIPHQIHLQEM | 419 |
| WP_002273241 | 357 --DGYAG YIDG K TNQEAFYKYLKGLLNK-I--EGSGYFL--DKIEREDELRKQRTFDNGSIPHQIHLQEM | 419 |
| WP_002275430 | 357 --DGYAG YIDG K TNQEAFYKYLKGLLNK-I--EGSGYFL--DKIEREDFLRKQRTFDNGSIPHQIHLQEM | 419 |
| WP_002276448 | 357 --DGYAG YIDG K TNQEAFYKYLKGLLNK-I--EGSGYFL--DKIEREDFLRKQRTFDNGSIPHQIHLQEM | 419 |
| WP_002277050 | 357 --NGYAG YIEN G VKQDEFYKYLKNTLSK-I--AGSDYFL--DKIEREDFLRKQRTFDNGSIPHQIHLQEM | 419 |
| WP_002277364 | 357 --DGYAG YIDG K TNQEAFYKYLKGLLNK-I--EGSGYFL--DKIEREDFLRKQRTFDNGSIPHQIHLQEM | 419 |
| WP_002279025 | 357 --DGYAG YIDG K TNQEAFYKYLKGLLNK-I--EGSGYFL--DKIEREDFLRKQRTFDNGSIPHQIHLQEM | 419 |
| WP_002279859 | 357 --DGYAG YIDG K TNQEAFYKYLKGLLNK-I--EGSGYFL--DKIEREDFLRKQRTFDNGSIPHQIHLQEM | 419 |
| WP_002280230 | 357 --DGYAG YIDG K TNQEAFYKYLKGLLNK-I--EGSGYFL--DKIEREDFLRKQRTEDNGSIPHQIHLQEM | 419 |
| WP_002281696 | 357 --DGYAG YIDG K TNQEAFYKYLKGLLNK-I--EGSGYFL--DKIEREDFLRKQRTFDNGSIPHQIHLQEM | 419 |
| WP_002282247 | 357 --NGYAG YIEN G VKQDEFYKYLKNTLSK-I--TGSDYFL--DQIEREDFLRKQRTFDNGSIPHQIHLQEM | 419 |
| WP_002282906 | 357 --DGYAG YIDG K TNQEAFYKYLKGLLNK-I--EGSGYFL--DKIEREDFLRKQRTFDNGSIPHQIHLQEM | 419 |
| WP_002283846 | 357 --DGYAG YIDG K TNQEAFYKYLKGLLNK-I--EGSGYFL--DKIEREDFLRKQRTFDNGSIPHQIHLQEM | 419 |
| WP_002287255 | 357 --DGYAG YIDG K TNQEAFYKYLKGLLNK-I--EGSGYFL--DKIEREDFLRKQRTFDNGSIPHQIHLQEM | 419 |

-continued

```
WP_002288990    357  --DGYAG YIDG K TNQEAFYKYLKGLLNK-I--EGSGYFL--DKIEREDFLRKQRTFDNGSIPHQIHLQEM    419

WP_002289641    357  --DGYAG YIDG K TNQEAFYKYLKGLLNK-I--EGSGYFL--DKIEREDFLRKQRTFDNGSIPHQIHLQEM    419

WP_002290427    357  --DGYAG YIDG K TNQEAFYKYLKGLLNK-I--EGSGYFL--DKIEREDFLRKQRTFDNGSIPHQIHLQEM    419

WP_002295753    357  --DGYAG YIDG K TNQEAFYKYLKGLLNK-I--EGSGYFL--DKIEREDFLRKQRTFDNGSIPHQIHLQEM    419

WP_002296423    357  --DGYAG YIDG K TNQEAFYKYLKGLLNK-I--EGSGYFL--DKIEREDFLRKQRTFDNGSIPHQIHLQEM    419

WP_002304487    357  --NGYAG YVGA D ATEEEFYKYVKGILNK-V--EGADVWL--DKIDREDFLRKQRTFDNGSIPHQIHLQEM    429

WP_002305844    357  --DGYAG YIDG K TNQEAFYKYLKGLLNK-I--EGSGYFL--DKIEREDFLRKQRTFDNGSIPHQIHLQEM    419

WP_002307203    357  --DGYAG YIDG K TNQEAFYKYLKGLLNK-I--EGSGYFL--DKIEREDFLRKQRTEDNGSIPHQIHLQEM    419

WP_002310390    357  --DGYAG YIDG K TNQEAFYKYLKGLLNK-I--EGSGYFL--DKIEREDFLRKQRTFDNGSIPHQIHLQEM    419

WP_002352408    357  --DGYAG YIDG K TNQEAFYKYLKGLLNK-I--EGSGYFL--DKIEREDFLRKQRTEDNGSIPHQIHLQEM    419

WP_012997688    357  --DGYAG YIDG K TNQEAFYKYLKGLLNK-I--EGSGYFL--DKIEREDFLRKQRTFDNGSIPHQIHLQEM    419

WP_014677909    357  --DGYAG YIDG K TNQEAFYKYLKGLLNK-I--EGSGYFL--DKIEREDFLRKQRTFDNGSIPHQIHLQEM    419

WP_019312892    357  --DGYAG YIDG K TNQEAFYKYLKGLLNK-I--EGSGYFL--DKIEREDFLRKQRTFDNGSIPHQIHLQEM    419

WP_019313659    357  --DGYAG YIDG K TNQEAFYKYLKGLLNK-I--EGSGYFL--DKIEREDFLRKQRTFDNGSIPHQIHLQEM    419

WP_019314093    357  --DGYAG YIDG K TNQEAFYKYLKGLLNK-I--EGSGYFL--DKIEREDFLRKQRTFDNGSIPHQIHLQEM    419

WP_019315370    357  --DGYAG YIDG K TNQEAFYKYLKGLLNK-I--EGNGYFL--DKIEREDFLRKQRTFDNGSIPHQIHLQEM    419

WP_019803776    357  --DGYAG YIDG K TNQEAFYKYLKGLLNK-I--EGSGYFL--DKIEREDFLRKQRTFDNGSIPHQIHLQEM    419

WP_019805234    357  --DGYAG YIDG K TNQEAFYKYLKGLLNK-I--EGSGYFL--DKIEREDFLRKQRTFDNGSIPHQIHLQEM    419

WP_024783594    357  --DGYAG YIDG K TNQEAFYKYLKGLLNK-I--EGSGYFL--DKIEREDFLRKQRTFDNGSIPHQIHLQEM    419

WP_024784288    357  --NGYAG YIEN G VKQDEFYKYLKNTLSK-I--TGSDYFL--DQIEREDFLRKQRTFDNGSIPHQIHLQEM    419

WP_024784666    357  --DGYAG YIDG K TNQEAFYKYLKGLLNK-I--EGSGYFL--DKIEREDFLRKQRTFDNGSIPHQIHLQEM    419

WP_024784894    357  --DGYAG YIDG K TNQEAFYKYLKGLLNK-I--EGSGYFL--DKIEREDFLRKQRTFDNGSIPHQIHLQEM    419

WP_024786433    357  --NGYAG YIEN G VKQDEFYKYLKNTLSK-I--AGSDYFL--DKIEREDFLRKQRTFDNGSIPHQIHLQEM    419

WP_049473442    357  --DGYAG YIDG K TNQEAFYKYLKGLLNK-I--EGSGYFL--DKIEREDFLRKQRTFDNGSIPHQIHLQEM    419

WP_049474547    357  --DGYAG YIDG K TNQEAFYKYLKGLLNK-I--EGSGYFL--DKIEREDFLRKQRTFDNGSIPHQIHLQEM    419

EMC03581        350  --DGYAG YIDG K TNQEAFYKYLKGLLNK-I--EGSGYFL--DKIEREDFLRKQRTFDNGSIPHQIHLQEM    412

WP_000428612    358  --DGYAG YIDG K TTQESFYKYIKNLLSK-F--EGADYFL--EKIEREDFLRKQRTFDNGSIPHQIHLQEM    420

WP_000428613    358  --DGYAG YIDG K TTQEAFYKYIKNLLSK-F--EGTDYFL--EKIEREDFLRKQRTFDNGSIPHQIHLQEM    420

WP_049523028    357  --DGYAG YIDG K TTQEGFYKYIKNLISK-I--EGAEYFL--EKIEREDFLRKQRTFDNGSIPHQIHLQEM    419

WP_003107102    326  --NGYAG YING K TSQEDFYKYIKPILSK-L--KGAESLIs--KLEREDELRKQRTFDNGSIPHQIHLNEL   388

WP_054279288    359  --DGYAG YISG K TSQEAFYKYIKPILET-L--DGAEDFLt--KINREDFLRKQRTFDNGSIPHQIHLGEL   421

WP_049531101    358  --EGYAG YIDS K TTQEAFYKYIKNLLSK-I--DGADYLL--DKIEREDFLRKQRTFDNGSIPHQIHLQEM   420

WP_049538452    358  --DGYAG YVDG K TTQEAFYKYIKNLLSK-F--EGADYFL--EKIEREDFLRKQRTFDNGSIPHQIHLQEM   420

WP_049549711    358  --DGYAG YIDG K TTQEAFYKYIKNLLSK-F--EGTDYFL--EKIEREDFLRKQRTFDNGSIPHQIHLQEM   420

WP_007896501    359  --NGYAG YIEG K VSQEDFYRYIKPILSR-L--KGGDEFLa--KIDRDDFLRKQRTFDNGSIPHQIHLKEL   421

EFR44625        311  --NGYAG YIEG K VSQEDFYRYIKPILSR-L--KGGDEFLa--KIDRDDFLRKQRTFDNGSIPHQIHLKEL   373

WP_002897477    357  --DGYAG YIDG K TTQEAFYKYIKNLLSK-F--EGADYFL--DKIEREDFLRKQRTFDNGSIPHQIHLQEM   419

WP_002906454    357  --DGYAG FIDG K TTQEAFYKYIKNLLSK-L--EGADYFL--NKIEREDFLRKQRTFDNGSIPHQIHLQEM   419

WP_009729476    358  --DGYAG YIDG K TTQETFYKYIKNLLSK-F--EGADYFL--DKIEREDFLRKQRTFDNGSIPHQIHLQEM   420

CQR24647        358  --NGYAG YIDG K TNQEDFYKYLKNLLQK-V--DGGDYFI--EKIEREDFLRKQRTFDNGSIPHQVHLDEM   420

WP_000066813    358  --DGYAG YIDG K TTQEAFYKYIKNLLSK-F--EGADYFL--DKIEREDFLKKQRTFDNGSIPHQIHLQEM   420
```

-continued

```
WP_009754323  358  --DGYAG YIDG K TTQEAFYKYIKNLLSK-F--EGADYFL--DKIEREDFLRKQRTFDNGSIPHQIHLQEM  420
WP_044674937  357  --DGYAG YIEG K TTQENFYRFIKKAIEK-I--EGSDYFI--DKIDREDFLRKQRTFDNGSIPHQIHLQEM  419
WP_044676715  357  --DGYAG YIEG K TTQENFYRFIKKAIEK-I--EGSNYFI--DKIDREDFLRKQRTFDNGSIPHQIHLQEM  419
WP_044680361  357  --DGYAG YIEG K TTQENFYRFIKKAIEK-I--EGSNYFI--DKIDREDFLRKQRTFDNGSIPHQIHLQEM  419
WP_044681799  357  --DGYAG YIEG K TTQENFYRFIKKAIEK-I--EGSDYFI--DKIDREDFLRKQRTFDNGSIPHQIHLQEM  419
WP_049533112  357  --KGYAG YIEN G VKQDEFYKYLKGILLQ-I--NGSGDFL--DKIDREDFLRKQRTFDNGSIPHQIHLQEM  419
WP_029090905  316  fyTDYIG YEES K SKEERLFKHIELLLAKeNvlTTVEHALleKNITFASLLPLQRSSRNAVIPYQVHEKEL  403
WP_006506696  361  ksKGYYN YINR K APVDEFYKYVKKCIEK-VdtPEAKQILn--DIELENFLLKQNSRINGSVPYQMQLDEM  429
AIT42264      357  --NGYAG YIDG G ASQEEFYKFIKPILEK-M--DGTEELLv--KLNREDLLRKQRTFDNGSIPHQIHLGEL  419
WP_034440723  363  --NGYAG YIDG K TSQEDFYKFVKAQLKG---eENGEYFL--EAIENENFLRKQRSFYNGVIPYQIHLQEL  425
AKQ21048      357  --NGYAG YIDG G ASQEEFYKFIKPILEK-M--DGTEELLv--KLNREDLLRKQRTEDNGSIPHQIHLGEL  419
WP_004636532  356  --NGYAG YIDG K TNQEDFYKYIEKVMKT-IksDKKDYFL--DKIDREVFLRKQRSFYNSVIPHQIHLQEM  420
WP_002364836  363  --DGYAG YIAH A VSQLKFYQYVKKIIQD-I--AGAEYFL--EKIAQENFLRKQRTFDNGVIPHQIHLAEL  427
WP_016631044  314  --DGYAG YIAH A VSQLKFYQYVKKIIQD-I--AGAEYFL--EKIAQENFLRKQRTFDNGVIPHQIHLAEL  378
EMS75795      100  --NGYAG YIDG K TTQEDFYKFLKKELNG-I--AGSERFM--EKVDQENFLLKQRTTANGVIPHQVHLTEL  162
WP_002373311  363  --DGYAG YIAH A VSQLKFYQYVKKIIQD-I--AGAEYFL--EKIAQENFLRKQRTFDNGVIPHQIHLAEL  427
WP_002378009  363  --DGYAG YITH A VSQLKFYQYVKKIIQD-I--AGAEYFL--EKIAQENFLRKQRTEDNGVIPHQIHLAEL  427
WP_002407324  363  --DGYAG YITH A VSQLKFYQYVKKIIQD-I--AGAEYFL--EKIAQENFLRKQRTFDNGVIPHQIHLAEL  427
WP_002413717  363  --DGYAG YITH A VSQLKFYQYVKKIIQD-I--AGAEYFL--EKIAQENFLRKQRTEDNGVIPHQIHLAEL  427
WP_010775580  365  --DGYAG YIAH A VSQLKFYQYVKKIIQD-I--AGAEYFL--EKIAQENFLRKQRTFDNGVIPHQIHLAEL  429
WP_010818269  363  --DGYAG YIAH A VSQLKFYQYVKKIIQD-I--AGAEYFL--EKIAQENFLRKQRTFDNGVIPHQIHLAEL  427
WP_010824395  363  --DGYAG YITH A VSQLKFYQYVKKIIQD-I--AGAEYFL--EKIAQENFLRKQRTFDNGVIPHQIHLAEL  427
WP_016622645  363  --DGYAG YIAH A VSQLKFYQYVKKIIQD-I--AGAEYFL--EKIAQENFLRKQRTEDNGVIPHQIHLAEL  427
WP_033624816  363  --DGYAG YIAH A VSQLKFYQYVKKIIQD-I--AGAEYFL--EKIAQENFLRKQRTFDNGVIPHQIHLAEL  427
WP_033625576  363  --DGYAG YIAH A VSQLKFYQYVKKIIQD-I--AGAEYFL--EKIAQENFLRKQRTFDNGVIPHQIHLAEL  427
WP_033789179  363  --DGYAG YIAH A VSQLKFYQYVKKIIQD-I--AGAEYFL--EKIAQENFLRKQRTFDNGVIPHQIHLAEL  427
WP_002310644  361  --NGYAG YIEG H ATQEDFYKFVKKELTG-I--RGSEVFL--TKIEQENFLRKQRTFDNGVIPHQIHLTEL  423
WP_002312694  362  --NGYAG YIEG H ATQEAFYKFVKKELTG-I--RGSEVFL--TKIEQENFLRKQRTFDNGVIPHQIHLSEL  424
WP_002314015  362  --NGYAG YIEG H ATQEDFYKFVKKELIG-I--RGSEVFL--TKIEQENFLRKQRTFDNGVIPHQIHLTEL  424
WP_002320716  362  --NGYAG YIEG H ATQEDFYKFVKKELTG-I--RGSEVFL--TKIEQENFLRKQRTFDNGVIPHQIHLTEL  424
WP_002330729  361  --NGYAG YIEG H ATQEDFYKFVKKELTG-I--RGSEVFL--TKIEQENFLRKQRTFDNGVIPHQIHLTEL  423
WP_002335161  362  --NGYAG YIEG H ATQEDFYKFVKKELTG-I--RGSEVFL--TKIEQENFLRKQRTFDNGVIPHQIHLTEL  424
WP_002345439  362  --NGYAG YIEG H ATQEDFYKFVKKELTG-I--RGSEVFL--TKIEQENFLRKQRTFDNGVIPHQIHLTEL  424
WP_034867970  355  --NGYAG YIKG K TTQEEFYKFVKKELSG-V--VGSEPFL--EKIDQETFLLKQRTYTNGVIPHQVHLIEL  417
WP_047937432  362  --NGYAG YIEG H ATQEDFYKFVKKELTG-I--RGSEVFL--TKIEQENFLRKQRTFDNGVIPHQIHLTEL  424
WP_010720994  355  --NGYAG YIKG K TTQEEFYKFVKKELSG-V--VGSEPFL--EKIDQETFLLKQRTYTNGVIPHQVHLIEL  417
WP_010737004  355  --NGYAG YIKG K TTQEEFYKFVKKELSG-V--VGSEPFL--EKIDQETFLLKQRTYTNGVIPHQVHLIEL  417
WP_034700478  355  --NGYAG YIKG K TTQEEFYKFVKKELSG-V--VGSEPFL--EKIDQETFLLKQRTYTNGVIPHQVHLIEL  417
WP_007209003  359  --NGYAG YIDG K TKEEEFYKYLKTTLVQ---kSGYQYFI--EKIEQENFLRKQRIYDNGVIPHQVHAEEL  421
WP_023519017  355  --NGYAG YVKG K ATQEDFYKFLRTELAG-L--EESQSIM--EKIDLEIYLLKQRTFANGVIPHQIHLVEM  417
```

-continued

```
WP_010770040    358  --SGYAG YVEN S VTQAEFYKYIKKAIEK-V--PGAEYFL--EKIEQETFLDKQRTENNGVIPHQIHLEEL   422
WP_048604708    354  --DGYAG YIDN S TSQEKFYKYITNLIEK-I--DGAEYFL--KKIENEDFLRKQTFDNGIIPHQIHLEEL   418
WP_010750235    355  --DGYAG YIDG K TTQADFYKFLKKELTG-V--PGSEPML--AKIDQENFLLKQRTPINGVIPHQVHLTEF   417
AII16583        396  --NGYAG YIDG G ASQEEFYKFIKPILEK-M--DGTEELLv--KLNREDLLRKQRTFDNGSIPHQIHLGEL   458
WP_029073316    367  kkNNYCN YINH K TPVDEFYKYIKKLIEK-Idd PDVKTILn--KIELESFMLKQNSRINGAVPYQMQLDEL   435
WP_031589969    367  kkNNYCN YINH K TPVDEFYKYIKKLIEK-Idd PDVKTILn--KIELESFMLKQNSRINGAVPYQMQLDEL   435
KDA45870        354  -iSGYAG YIDG K VSEEDFYKYTKKTLKG-I--PETEEILq--KIDANNYLRKQRTFDNGAIPHQVHLKEL   417
WP_039099354    360  ------- YVDG K -SKEDFYGDITKALKNnPdhPIVSEIKk--LIELDQFMPKQRTKDNGAIPHQLHQQEL   425
AKP02966        349  --QAYDD YINK K ---KELYTSLKKFLKVaLp-TNLAKEAe-EKISKGTYLVKPRNSENGVVPYQLNKIEM   415
WP_010991369    363  --HGYAG YIDG - TKQADFYKYMKMTLEN-I--EGADYFI--AKIEKENFLRKQRTFDNGAIPHQLHLEEL   425
WP_033838504    363  --HGYAG YIDG - TKQADFYKYMKMTLEN-I--EGADYFI--AKIEKENFLRKQRTFDNGAIPHQLHLEEL   425
EHN60060        366  --HGYAG YIDG - TKQADFYKYMKMTLEN-I--EGADYFI--AKIEKENFLRKQRTFDNGAIPHQLHLEEL   428
EFR89594        132  --HGYAG YIDG - TKQADFYKYMKTTLEN-I--EGADYFI--AKIEKENFLRKQRTFDNGAIPHQLHLEEL   194
WP_038409211    363  --DGYAG YIDG - TTQEKFYKYMKKMLAN-I--DGADYFI--DQIEEENFLRKQRTFDNGTIPHQLHLEEL   425
EFR95520          1  ------- ---- - ---------MKKMLAN-I--DGADYFI--DQIEEENFLRKQRTFDNGTIPHQLHLEEL    44
WP_003723650    363  --DGYAG YIDG - TKQVDFYKYLKTILEN-I--EGSDYFI--AKIEEENFLRKQRTFDNGAIPHQLHLEEL   425
WP_003727705    363  --DGYAG YIDG - TKQVDFYKYLKTTLEN-V--EGADYFI--TKIEEENFLRKQRTFDNGVIPHQLHLEEL   425
WP_003730785    363  --DGYAG YIDG - TKQVDFYKYLKTTLEN-V--EGADYFI--TKIEEENFLRKQRTFDNGVIPHQLHLEEL   425
WP_003733029    363  --HGYAG YISG - TKQADFYKYMKATLEK-I--EGADYFI--AKIEEENFLRKQRTFDNGVIPHQLHLEEL   425
WP_003739838    363  --DGYAG YIDG - TKQVDFYKYLKTLLEN-I--EGADYFI--AKIEEENFLRKQRTEDNGAIPHQLHLEEL   425
WP_014601172    363  --DGYAG YIDG - TKQVDFYKYLKTILEN-I--EGADYFI--AKIEEENFLRKQRTEDNGAIPHQLHLEEL   425
WP_023548323    363  --DGYAG YIDG - TKQVDFYKYLKTTLEN-V--EGADYFI--TKIEEENFLRKQRTEDNGVIPHQLHLEEL   425
WP_031665337    363  --DGYAG YIDG - TKQVDFYKYLKTILEN-I--EGSDYFI--AKIEEENFLRKQRTEDNGAIPHQLHLEEL   425
WP_031669209    363  --HGYAG YISG - TKQADFYKYMKATLEK-I--EGADYFI--AKIEEENFLRKQRTFDNGVIPHQLHLEEL   425
WP_033920898    363  --DGYAG YIDG - TKQVDFYKYLKTILEN-I--EGADYFI--AKIEEENFLRKQRTFDNGAIPHQLHLEEL   425
AKI42028        366  --DGYAG YIDG - TKQVDFYKYLKTILEN-I--EGADYFI--AKIEEENFLRKQRTFDNGAIPHQLHLEEL   428
AKI50529        366  --DGYAG YIDG - TKQVDFYKYLKTILEN-I--EGADYFI--AKIEEENFLRKQRTFDNGAIPHQLHLEEL   428
EFR83390             ------- ---- - ------------------------------------------------------
WP_046323366    363  --DGYAG YIEG - TKQEAFYKYMKKMLEH-V--EGADYFI--NQIEEENFLRKQRTFDNGAIPHQLHLEEL   425
AKE81011        373  --NGYAG YIDG G ASQEEFYKFIKPILEK-M--DGTEELLv--KLNREDLLRKQRTFDNGSIPHQIHLGEL   435
CUO82355        365  kvKGYYN YINR K APVDEFYKFVKKCIEK-Vdt PEAKQILh--DIELENFLLKQNSRINGSVPYQMQLDEM   433
WP_033162887    366  klHNYLG YIKY D TPVEEFYKYIKGLLAK-Vdt DEAREILe--RIDLEKFMLKQNSRINGSIPYQMQKDEM   434
AGZ01981        390  --NGYAG YIDG G ASQEEFYKFIKPILEK-M--DGTEELLv--KLNREDLLRKQRTFDNGSIPHQIHLGEL   452
AKA60242        357  --NGYAG YIDG G ASQEEFYKFIKPILEK-M--DGTEELLv--KLNREDLLRKQRTFDNGSIPHQIHLGEL   419
AKS40380        357  --NGYAG YIDG G ASQEEFYKFIKPILEK-M--DGTEELLv--KLNREDLLRKQRTFDNGSIPHQIHLGEL   419
4UN5_B          361  --NGYAG YIDG G ASQEEFYKFIKPILEK-M--DGTEELLv--KLNREDLLRKQRTFDNGSIPHQIHLGEL   423
WP_010922251    420  HAILRRQEDFYPFLKD--NRE KIEKILTFRIPYYVGPL ARG-n-SRFAWMTR---KSEETITPWNFEEVDKGA   486
WP_039695303    423  HAILRRQGDYYPFLKE--KQD RIEKILTFRIPYYVGPL VRKD--SRFAWAEY---RSDEKITPWNEDKVIDKEK   489
WP_045635197    420  NAILRRQGEYYPFLKD--NKE KIEKILTFRIPYYVGPL ARGN--RDFAWLTR---NSDEAIRPWNFEEIVDKAS   486
5AXW_A          184  KQLLKVQKAYHQLDQSfi--D TYIDLLETRRTYYEGPG ---Eg-SPFGWKDI---------------------   229
```

-continued

| | | | |
|---|---|---|---|
| WP_009880683 | 104 HAILRRQEDFYPFLKD--NRE KIEKILTFRIPYYVGPL ARG-n-SRFAWMTR---KSEETITPWNFEEVVDKGA | 170 |
| WP_010922251 | 420 HAILRRQEDFYPFLKD--NRE KIEKILTFRIPYYVGPL ARG-n-SRFAWMTR---KSEETITPWNFEEVVDKGA | 486 |
| WP_011054416 | 420 HAILRRQEDFYPFLKD--NRE KIEKILTFRIPYYVGPL ARG-n-SRFAWMTR---KSEETITPWNFEEVVDKGA | 486 |
| WP_011284745 | 420 HAILRRQEDFYPFLKD--NRE KIEKILTFRIPYYVGPL ARG-n-SRFAWMTR---KSEETITPWNFEEVVDKGA | 486 |
| WP_011285506 | 420 HAILRRQEDFYPFLKD--NRE KIEKILTFRIPYYVGPL ARG-n-SRFAWMTR---KSEETITPWNFEEVVDKGA | 486 |
| WP_011527619 | 420 HAILRRQEDFYPFLKD--NRE KIEKILTFRIPYYVGPL ARG-n-SRFAWMTR---KSEETITPWNFEEVVDKGA | 486 |
| WP_012560673 | 420 HAILRRQEDFYPFLKD--NRE KIEKILTFRIPYYVGPL ARG-n-SRFAWMTR---KSEETITPWNFEEVVDKGA | 486 |
| WP_014407541 | 420 HAILRRQEDFYPFLKD--NRE KIEKILTFRIPYYVGPL ARG-n-SRFAWMTR---KSEETITPWNFEEVVDKGA | 486 |
| WP_020905136 | 420 HAILRRQEDFYPFLKD--NRE KIEKILTFRIPYYVGPL ARG-n-SRFAWMTR---KSEETITPWNFEEVVDKGA | 486 |
| WP_023080005 | 420 HAILRRQEDFYPFLKD--NRE KIEKILTFRIPYYVGPL ARG-n-SRFAWMTR---KSEETITPWNFEEVVDKGA | 486 |
| WP_023610282 | 420 HAILRRQEDFYPFLKD--NRE KIEKILTFRIPYYVGPL ARG-n-SRFAWMTR---KSEETITPWNFEEVVDKGA | 486 |
| WP_030125963 | 420 HAILRRQEDFYPFLKD--NRE KIEKILTFRIPYYVGPL ARG-n-SRFAWMTR---KSEETITPWNFEEVVDKGA | 486 |
| WP_030126706 | 420 HAILRRQEDFYPFLKD--NRE KIEKILTFRIPYYVGPL ARG-n-SRFAWMTR---KSEETITPWNFEEVVDKGA | 486 |
| WP_031488318 | 420 HAILRRQEDFYPFLKD--NRE KIEKILTFRIPYYVGPL ARG-n-SRFAWMTR---KSEETITPWNFEEVVDKGA | 486 |
| WP_032460140 | 420 HAILRRQEDFYPFLKD--NRE KIEKILTFRIPYYVGPL ARG-n-SRFAWMTR---KSEETITPWNFEEVVDKGA | 486 |
| WP_032461047 | 420 HAILRRQEDFYPFLKD--NRE KIEKILTFRIPYYVGPL ARG-n-SRFAWMTR---KSEETITPWNFEEVVDKGA | 486 |
| WP_032462016 | 420 HAILRRQEDFYPFLKD--NRE KIEKILTFRIPYYVGPL ARG-n-SRFAWMTR---KSEETITPWNFEEVVDKGA | 486 |
| WP_032462936 | 420 HAILRRQEDFYPFLKD--NRE KIEKILTFRIPYYVGPL ARG-n-SRFAWMTR---KSEETITPWNFEEVVDKGA | 486 |
| WP_032464890 | 420 HAILRRQEDFYPFLKD--NRE KIEKILTFRIPYYVGPL ARG-n-SRFAWMTR---KSEETITPWNFEEVVDKGA | 486 |
| WP_033888930 | 245 HAILRRQEDFYPFLKD--NRE KIEKILTFRIPYYVGPL ARG-n-SRFAWMTR---KSEETITPWNFEEVVDKGA | 311 |
| WP_038431314 | 420 HAILRRQEDFYPFLKD--NRE KIEKILTFRIPYYVGPL ARG-n-SRFAWMTR---KSEETITPWNFEEVVDKGA | 486 |
| WP_038432938 | 420 HAILRRQEDFYPFLKD--NRE KIEKILTFRIPYYVGPL ARG-n-SRFAWMTR---KSEETITPWNFEEVVDKGA | 486 |
| WP_038434062 | 420 HAILRRQEDFYPFLKD--NRE KIEKILTFRIPYYVGPL ARG-n-SRFAWMTR---KSEETITPWNFEEVVDKGA | 486 |
| BAQ51233 | 331 HAILRRQEDFYPFLKD--NRE KIEKILTFRIPYYVGPL ARG-n-SRFAWMTR---KSEETITPWNFEEVVDKGA | 397 |
| KGE60162 | -------------------- ---------------- ----------------------------------- | |
| KGE60856 | -------------------- ---------------- ----------------------------------- | |
| WP_002989955 | 420 HAILRRQEDFYPFLKD--NRE KIEKILTFRIPYYVGPL ARG-n-SRFAWMTR---KSEETITPWNFEEVVDKGA | 486 |
| WP_003030002 | 420 HAILRRQEEHYPFLKE--NQD KIEKILTFRIPYYVGPL ARKG--SRFAWAEY---KADEKITPWNEDDILDKEK | 486 |
| WP_003065552 | 423 HAILRRQGDYYPFLKE--NQD RIEKILTFRIPYYVGPL ARKD--SRFSWAEY---HSDEKITPWNFDKVIDKEK | 489 |
| WP_001040076 | 421 RAIIRRQSEYYPFLKE--NLD RIEKILTFRIPYYVGPL AREK--SDFAWMTR---KTDDSIRPWNFEDLVDKEK | 487 |
| WP_001040078 | 421 KAIIRRQSEYYPFLKE--NQD RIEKILTFRIPYYIGPL AREK--SDFAWMTR---KTDDSIRPWNFEDLVDKEK | 487 |
| WP_001040080 | 421 KAIIRRQSEYYPFLKE--NQD RIEKILTFRIPYYIGPL AREK--SDFAWMTR---KTDDSIRPWNFEDLVDKEK | 487 |
| WP_001040081 | 421 KAIIRRQSEYYPFLKE--NQD RIEKILTFRIPYYIGPL AREK--SDFAWMTR---KTDDSIRPWNFEDLVDKEK | 487 |
| WP_001040083 | 421 KAIIRRQSEYYPFLKE--NQD RIEKILTFRIPYYIGPL AREK--SDFAWMTR---KTDDSIRPWNFEDLVDKEK | 487 |
| WP_001040085 | 421 KAIIRRQSEYYPFLKE--NQD RIEKILTFRIPYYIGPL AREK--SDFAWMTR---KTDDSIRPWNFEDLVDKEK | 487 |
| WP_001040087 | 421 KAIIRRQSEYYPFLKE--NQD RIEKILTFRIPYYIGPL AREK--SDFAWMTR---KTDDSIRPWNFEDLVDKEK | 487 |
| WP_001040088 | 421 KAIIRRQSEYYPFLKE--NQD RIEKILTFRIPYYIGPL AREK--SDFAWMTR---KTDDSIRPWNFEDLVDKEK | 487 |
| WP_001040089 | 421 KAIIRRQSEYYPFLKE--NQD RIEKILTFRIPYYIGPL AREK--SDFAWMTR---KTDDSIRPWNFEDLVDKEK | 487 |
| WP_001040090 | 421 KAIIRRQSEYYPFLKE--NQD RIEKILTFRIPYYIGPL AREK--SDFAWMTR---KTDDSIRPWNFEDLVDKEK | 487 |
| WP_001040091 | 421 KAIIRRQSEYYPFLKE--NQD RIEKILTFRIPYYIGPL AREK--SDFAWMTR---KTDDSIRPWNFEDLVDKEK | 487 |
| WP_001040092 | 421 KAIIRRQSEYYPFLKE--NQD RIEKILTFRIPYYVGPL ARGN--SDFAWMTR---KTDDSIRPWNFEDLVDKEK | 487 |

-continued

```
WP_001040094    421 RAIIRRQSEYYPFLKE--NLD RIEKILTFRIPYYVGPL AREK--SDFAWMTR---KTDDSIRPWNFEDLVDKEK    487
WP_001040095    421 RAIIRRQSEYYPFLKE--NLD RIEKILTFRIPYYVGPL AREK--SDFAWMTR---KTDDSIRPWNFEDLVDKEK    487
WP_001040096    421 RAIIRRQSEYYPFLKE--NLD RIEKILTFRIPYYVGPL AREK--SDFAWMTR---KTDDSIRPWNFEDLVDKEK    487
WP_001040097    421 RAIIRRQSEYYPFLKE--NLD RIEKILTFRIPYYVGPL AREK--SDFAWMTR---KTDDSIRPWNFEDLVDKEK    487
WP_001040098    421 RAIIRRQSEYYPFLKE--NLD RIEKILTFRIPYYVGPL AREK--SDFAWMTR---KTDDSIRPWNFEDLVDKEK    487
WP_001040099    421 RAIIRRQSEYYPFLKE--NLD RIEKILTFRIPYYVGPL AREK--SDFAWMTR---KTDDSIRPWNFEDLVDKEK    487
WP_001040100    421 RAIIRRQSEYYPLLKE--NLD RIEKILTFRIPYYVGPL AREK--SDFAWMTR---KTDDSIRPWNFEDLVDKEK    487
WP_001040104    421 KAIIRRQSEYYPFLKE--NQD RIEKILTFRIPYYIGPL AREK--SDFAWMTR---KTDDSIRPWNFEDLVDKEK    487
WP_001040105    421 KAIIRRQSEYYPFLKE--NQD RIEKILTFRIPYYIGPL AREK--SDFAWMTR---KTDDSIRPWNFEDLVDKEK    487
WP_001040106    421 KAIIRRQSEYYPFLKE--NLD RIEKILTFRIPYYVGPL AREK--SDFAWMTR---KTDDSIRPWNFEELVDKEA    487
WP_001040107    421 KAIIRRQSEYYPFLKE--NLD RIEKILTFRIPYYVGPL AREK--SDFAWMTR---KTDDSIRPWNFEELVDKEA    487
WP_001040108    421 KAIIRRQSEYYPFLKE--NLD RIEKILTFRIPYYVGPL AREK--SDFAWMTR---KTDDSIRPWNFEELVDKEA    487
WP_001040109    421 KAIIRRQSEYYPFLKE--NLD RIEKILTFRIPYYVGPL AREK--SDFAWMTR---KTDDSIRPWNFEELVDKEA    487
WP_001040110    421 KAIIRRQSEYYPFLKE--NLD RIEKILTFRIPYYVGPL AREK--SDFAWMTR---KTDDSIRPWNFEELVDKEA    487
WP_015058523    421 KAIIRRQSEYYPFLKE--NQD KIEKILTFRIPYYVGPL ARGN--SDFAWMTR---KTDDSIRPWNFEDLVDKEK    487
WP_017643650    421 RAIIRRQSEYYPFLKE--NLD RIEKILTFRIPYYVGPL AREK--SDFAWMTR---KTDDSIRPWNFEDLVDKEK    487
WP_017647151    421 KAIIRRQSEYYPFLKE--NLD RIEKILTFRIPYYVGPL AREK--SDFAWMTR---KTDDSIRPWNFEELVDKEA    487
WP_017648376    421 KAIIRRQSEYYPFLKE--NLD RIEKILTFRIPYYVGPL AREK--SDFAWMTR---KTDDSIRPWNFEELVDKEA    487
WP_017649527    421 KAIIRRQSEYYPFLKE--NQD RIEKILTFRIPYYIGPL AREK--SDFAWMTR---KTDDSIRPWNFEDLVDKEK    487
WP_017771611    421 KAIIRRQSEYYPFLKE--NLD RIEKILTFRIPYYVGPL AREK--SDFAWMTR---KTDDSIRPWNFEELVDKEA    487
WP_017771984    421 KAIIRRQSEYYPFLKE--NQD RIEKILTFRIPYYIGPL AREK--SDFAWMTR---KTDDSIRPWNFEDLVDKEK    487
CFQ25032        421 KAIIRRQSEYYPFLKE--NQD RIEKILTFRIPYYIGPL AREK--SDFAWMTR---KTDDSIRPWNFEDLVDKEK    487
CFV16040        421 KAIIRRQSEYYPFLKE--NQD RIEKILTFRIPYYIGPL AREK--SDFAWMTR---KTDDSIRPWNFEDLVDKEK    487
KLJ37842        421 KAIIRRQSEYYPFLKE--NQD RIEKILTFRIPYYIGPL AREK--SDFAWMTR---KTDDSIRPWNFEDLVDKEK    487
KLJ72361        421 KAIIRRQSEYYPFLKE--NQD RIEKILTFRIPYYIGPL AREK--SDFAWMTR---KTDDSIRPWNFEDLVDKEK    487
KLL20707        421 KAIIRRQSEYYPFLKE--NQD RIEKILTFRIPYYIGPL AREK--SDFAWMTR---KTDDSIRPWNFEDLVDKEK    487
KLL42645        421 KAIIRRQSEYYPFLKE--NLD RIEKILTFRIPYYVGPL AREK--SDFAWMTR---KTDDSIRPWNFEELVDKEA    487
WP_047207273    421 KAIIRRQSEYYPFLKE--NQD RIEKILTFRIPYYIGPL AREK--SDFAWMTR---KTDDSIRPWNFEDLVDKEK    487
WP_047209694    421 RAIIRRQSEYYPFLKE--NLD RIEKILTFRIPYYVGPL AREK--SDFAWMTR---KTDDSIRPWNFEDLVDKEK    487
WP_050198062    421 KAIIRRQSEYYPFLKE--NQD RIEKILTFRIPYYIGPL AREK--SDFAWMTR---KTDDSIRPWNFEDLVDKEK    487
WP_050201642    421 KAIIRRQSEYYPFLKE--NQD RIEKILTFRIPYYIGPL AREK--SDFAWMTR---KTDDSIRPWNFEDLVDKEK    487
WP_050204027    421 KAIIRRQSEYYPFLKE--NLD RIEKILTFRIPYYVGPL AREK--SDFAWMTR---KTDDSIRPWNFEELVDKEA    487
WP_050881965    421 KAIIRRQSEYYPFLKE--NQD RIEKILTFRIPYYIGPL AREK--SDFAWMTR---KTDDSIRPWNFEDLVDKEK    487
WP_050886065    421 KDIIRRQSEYYPFLKE--NQD RIEKILTFRIPYYIGPL AREK--SDFAWMTR---KTDDSIRPWNFEDLVDKEK    487
AHN30376        421 KAIIRRQSEYYPFLKE--NQD KIEKILTFRIPYYVGPL ARGN--SDFAWMTR---KTDDSIRPWNFEDLVDKEK    487
EAO78426        421 KAIIRRQSEYYPFLKE--NQD RIEKILTFRIPYYIGPL AREK--SDFAWMTR---KTDDSIRPWNFEDLVDKEK    487
CCW42055        421 RAIIRRQSEYYPFLKE--NLD RIEKILTFRIPYYVGPL AREK--SDFAWMTR---KTDDSIRPWNFEELVDKEA    487
WP_003041502    420 HAILRRQGEHYPFLKE--NQD KIEKILTFRIPYYVGPL ARKG--SRFAWAEY---KADEKITPWNEDDILDKEK    486
WP_037593752    421 HAILRRQGEHYPFLKE--NQD KIEKILTFRIPYYVGPL ARKG--SRFAWAEY---KADEKITPWNEDDILDKEK    487
WP_049516684    421 HAILRRQGEHYPFLKE--NQD KIEKILTFRIPYYVGPL ARKG--SRFAWAEY---KADEKITPWNFDDILDKEK    487
```

-continued

| | | |
|---|---|---|
| GAD46167 | 420 HAILRRQGEHYPFLKE--NQD KIEKILTFRIPYYVGPL ARKG--SRFAWAEY---KADEKITPWNEDDILDKEK | 486 |
| WP_018363470 | 421 HAILRRQGDYYPFLKE--NQE EIEKILTFRIPYYVGPL ARKD--SRFAWAEY---RSDEKITPWNEDKVIDKEK | 487 |
| WP_003043819 | 430 HAILRRQEEFYPFLKE--NRE KIEKILTFRIPYYVGPL ARG-n-SRFAWLTR---KSEEAITPWNFEEVVDKGA | 496 |
| WP_006269658 | 420 HAILRRQGEHYPFLKE--NQD KIEKILTFRIPYYVGPL ARKG--SRFAWAEY---KADEKITPWNEDDILDKEK | 486 |
| WP_048800889 | 420 HAILRRQGEHYPFLKE--NQD KIEKILTFRIPYYVGPL VRKG--SRFAWAEY---KADEKITPWNEDDILDKEK | 486 |
| WP_012767106 | 420 HAILRRQEDFYPFLKD--NRE KIEKILTFRIPYYVGPL ARG-n-SRFAWMTR---KSEETITPWNFEEVVDKGA | 486 |
| WP_014612333 | 420 HAILRRQEDFYPFLKD--NRE KIEKILTFRIPYYVGPL ARG-n-SRFAWMTR---KSEETITPWNFEEVVDKGA | 486 |
| WP_015017095 | 420 HAILRRQEDFYPFLKD--NRE KIEKILTFRIPYYVGPL ARG-n-SRFAWMTR---KSEETITPWNFEEVVDKGA | 486 |
| WP_015057649 | 420 HAILRRQEDFYPFLKD--NRE KIEKILTFRIPYYVGPL ARG-n-SRFAWMTR---KSEETITPWNFEEVVDKGA | 486 |
| WP_048327215 | 420 HAILRRQEDFYPFLKD--NRE KIEKILTFRIPYYVGPL ARG-n-SRFAWMTR---KSEETITPWNFEEVVDKGA | 486 |
| WP_049519324 | 420 HAILRRQEDFYPFLKD--NRE KIEKILTFRIPYYVGPL ARG-n-SRFAWMTR---KSEETITPWNFEEVVDKGA | 486 |
| WP_012515931 | 420 HAILRRQEVFYPFLKD--NRK KIESLLTFRIPYYVGPL ARG-h-SRFAWVKR---KFDGAIRPWNFEEIVDEEA | 486 |
| WP_021320964 | 420 HAILRRQEVFYPFLKD--NRK KIESLLTFRIPYYVGPL ARG-h-SRFAWVKR---KFDGAIRPWNFEEIVDEEA | 486 |
| WP_037581760 | 420 HAILRRQEVFYPFLKD--NRK KIESLLTFRIPYYVGPL ARG-h-SRFAWVKR---KFDGAIRPWNFEEIVDEEA | 486 |
| WP_004232481 | 420 RTILRRQGEYYPFLKE--NQA KIEKILTFRIPYYVGPL ARKN--SRFAWAKY---HSDEPITPWNFDEVVDKEK | 486 |
| WP_009854540 | 421 HAILRRQGDYYPFLKE--KQD RIEKILTFRIPYYVGPL VRKD--SRFAWAEY---RSDEKITPWNEDKVIDKEK | 487 |
| WP_012962174 | 421 HAILRRQGEHYAFLKE--NQA KIEKILTFRIPYYVGPL ARKN--SRFAWAEY---HSDEKITPWNFDEIIDKEK | 487 |
| WP_039695303 | 423 HAILRRQGDYYPFLKE--KQD RIEKILTFRIPYYVGPL VRKD--SRFAWAEY---RSDEKITPWNFDKVIDKEK | 489 |
| WP_014334983 | 420 HSILRRQGDYYPFLKE--NQA KIEKILTFRIPYYVGPL ARKD--SRFAWANY---HSDEPITPWNFDEVVDKEK | 486 |
| WP_003099269 | 420 KAIIRRQEKFYPFLKE--NQK KIEKLFTFKIPYYVGPL ANG-q-SSFAWLKR---QSNESITPWNFEEVVDQEA | 486 |
| AHY15608 | 420 KAIIRRQEKFYPFLKE--NQK KIEKLFTFKIPYYVGPL ANG-q-SSFAWLKR---QSNESITPWNFEEVVDQEA | 486 |
| AHY17476 | 420 KAIIRRQEKFYPFLKE--NQK KIEKLFTFKIPYYVGPL ANG-q-SSFAWLKR---QSNESITPWNFEEVVDQEA | 486 |
| ESR09100 | -------------------- ----------------- ----------------------------------- | |
| AGM98575 | 420 KAIIRRQEKFYPFLKE--NQK KIEKLFTFKIPYYVGPL ANG-q-SSFAWLKR---QSNESITPWNFEEVVDQEA | 486 |
| ALF27331 | 420 RAIIRRQAEFYPFLAD--NQD RIEKILTFRIPYYIGPL ARGK--SDFSWLSR---KSADKITPWNFDEIVDKES | 486 |
| WP_018372492 | 433 QAIILNQSKYYPFLAE--NKE KIEKILTFRIPYYVGPL ARGN--SSFAWLQR---KSDEAIRPWNFEQVVDMET | 499 |
| WP_045618028 | 421 NAIIRRQGEHYPFLQE--NKE KIEKILTFRIPYYVGPL ARGN--RDFAWLTR---NSDQAIRPWNFEEIVDKAR | 487 |
| WP_045635197 | 420 NAILRRQGEYYPFLKD--NKE KIEKILTFRIPYYVGPL ARGN--RDFAWLTR---NSDEAIRPWNFEEIVDKAS | 486 |
| WP_002263549 | 420 RAIIRRQAEFYPFLAD--NQD RIEKLLTFRIPYYVGPL ARGK--SDFAWLSR---KSADKITPWNFDEIVDKES | 486 |
| WP_002263887 | 420 RAIIRRQAEFYPFLAD--NQD RIEKLLTFRIPYYVGPL ARGK--SDFAWLSR---KSADKITPWNFDEIVDKES | 486 |
| WP_002264920 | 420 HAILRRQGDYYPFLKE--NQD RIEKILTFRIPYYVGPL ARGK--SDFAWLSR---KSADKITPWNFDEIVDKES | 486 |
| WP_002269043 | 420 RAIIRRQAEFYPFLAD--NQD RIEKILTFRIPYYVGPL ARGK--SDFAWLSR---KSADKITPWNFDEIVDKES | 486 |
| WP_002269448 | 420 RAIIRRQAEFYPFLAD--NQD RIEKILTFRIPYYVGPL ARGK--SDFAWLSR---KSADKITPWNFDEIVDKES | 486 |
| WP_002271977 | 420 RAIIRRQAEFYPFLAD--NQD RIEKILTFRIPYYVGPL ARGK--SDFAWLSR---KSADKITPWNFDEIVDKES | 486 |
| WP_002272766 | 420 RAIIRRQAEFYPFLAD--NQD RIEKILTFRIPYYVGPL ARGK--SDFAWLSR---KSADKITPWNFDEIVDKES | 486 |
| WP_002273241 | 420 RAIIRRQAEFYPFLAD--NQD RIEKILTFRIPYYVGPL ARGK--SDFAWLSR---KSADKITPWNFDEIVDKES | 486 |
| WP_002275430 | 420 RAIIRRQAEFYPFLAD--NQD RIEKILTFRIPYYVGPL ARGK--SDFAWLSR---KSADKITPWNFDEIVDKES | 486 |
| WP_002276448 | 420 RAIIRRQAEFYPFLAD--NQD RIEKILTFRIPYYVGPL ARGK--SDFAWLSR---KSADKITPWNFDEIVDKES | 486 |
| WP_002277050 | 420 HAILRRQGDYYPFLKE--NQD RIEKILTFRIPYYVGPL ARKN--SRFAWAEY---HSDEAVMPWNEDQVIDKES | 486 |
| WP_002277364 | 420 RAIIRRQAEFYPFLAD--NQD RIEKILTFRIPYYVGPL ARGK--SDFAWLSR---KSADKITPWNFDEIVDKES | 486 |
| WP_002279025 | 420 RAIIRRQSEFYPFLAD--NQD RIEKILTFRIPYYVGPL ARGK--SDFAWLSR---KSADKITPWNFDEIVDKES | 486 |

-continued

| | | | |
|---|---|---|---|
| WP_002279859 | 420 | RAIIRRQAEFYPFLAD--NQD RIEKILTFRIPYYVGPL ARGK--SDFAWLSR---KSADKITPWNFDEIVDKES | 486 |
| WP_002280230 | 420 | RAIIRRQAEFYPFLAD--NQD RIEKILTFRIPYYVGPL ARGK--SDFAWLSR---KSADKITPWNFDEIVDKES | 486 |
| WP_002281696 | 420 | RAIIRRQAEFYPFLAD--NQD RIEKILTFRIPYYVGPL ARGK--SDFAWLSR---KSADKITPWNFDEIVDKES | 486 |
| WP_002282247 | 420 | HAILRRQGDYYPFLKE--NQD RIEKILTFRIPYYVGPL ARKN--SRFAWAEY---HSDEAVTPWNEDQVIDKES | 486 |
| WP_002282906 | 420 | RAIIRRQAEFYPFLAD--NQD RIEKLLTFRIPYYVGPL ARGK--SDFAWLSR---KSADKITPWNFDEIVDKES | 486 |
| WP_002283846 | 420 | RAIIRRQAEFYPFLAD--NQD RIEKILTFRIPYYVGPL ARGK--SDFAWLSR---KSADKITPWNFDEIVDKES | 486 |
| WP_002287255 | 420 | RAIIRRQAEFYPFLAD--NQD RIEKILTFRIPYYVGPL ARGK--SDFAWLSR---KSADKITPWNFDEIVDKES | 486 |
| WP_002288990 | 420 | RAIIRRQAEFYPFLAD--NQD RIEKILTFRIPYYVGPL ARGK--SDFAWLSR---KSADKITPWNFDEIVDKES | 486 |
| WP_002289641 | 420 | RAIIRRQAEFYPFLAD--NQD RIEKLLTFRIPYYVGPL ASGK--SDFAWLSR---KSADKITPWNFDEIVDKSS | 486 |
| WP_002290427 | 420 | RAIIRRQAEFYPFLAD--NQD RIEKILTFRIPYYVGPL ARGK--SDFAWLSR---KSADKITPWNFDEIVDKES | 486 |
| WP_002295753 | 420 | RAIIRRQAEFYPFLAD--NQD RIEKILTFRIPYYVGPL ARGK--SDFAWLSR---KSADKITPWNEDEIVDKEA | 486 |
| WP_002296423 | 420 | RAIIRRQAEFYPFLAD--NQD RIEKILTFRIPYYVGPL ARGK--SDFAWLSR---KSADKITPWNFDEIVDKES | 486 |
| WP_002304487 | 430 | HAILRRQGEHYPFLKE--NQD KIEKILTFRIPYYVGPL VRKG--SRFAWAEY---KADEKITPWNFDDILDKEK | 496 |
| WP_002305844 | 420 | RAIIRRQAEFYPFLAD--NQD RIEKILTFRIPYYVGPL ARGK--SDFAWLSR---KSADKITPWNFDEIVDKES | 486 |
| WP_002307203 | 420 | RAIIRRQAEFYPFLAD--NQD RIEKILTFRIPYYVGPL ARGK--SDFAWLSR---KSADKITPWNFDEIVDKES | 486 |
| WP_002310390 | 420 | RAIIRRQAEFYPFLAD--NQD RIEKILTFRIPYYVGPL ARGK--SDFAWLSR---KSADKITPWNFDEIVDKES | 486 |
| WP_002352408 | 420 | RAIIRRQAEFYPFLAD--NQD RIEKILTFRIPYYVGPL ARGK--SDFAWLSR---KSADKITPWNFDEIVDKES | 486 |
| WP_012997688 | 420 | RAIIRRQAEFYPFLAD--NQD RIEKILTFRIPYYVGPL ARGK--SDFAWLSR---KSADKITPWNFDEIVDKES | 486 |
| WP_014677909 | 420 | RAIIRRQAEFYPFLAD--NQD RIEKILTFRIPYYVGPL ARGK--SDFAWLSR---KSADKITPWNFDEIVDKES | 486 |
| WP_019312892 | 420 | RAIIRRQAEFYPFLAD--NQD RIEKILTFRIPYYVGPL ARGK--SDFAWLSR---KSADKITPWNFDEIVDKES | 486 |
| WP_019313659 | 420 | RAIIRRQAEFYPFLAD--NQD RIEKLLTFRIPYYVGPL ARGK--SDFAWLSR---KSADKITPWNFDEIVDKES | 486 |
| WP_019314093 | 420 | RAIIRRQAEFYPFLAD--NQD RIEKILTFRIPYYVGPL ARGK--SDFAWLSR---KSADKITPWNFDEIVDKES | 486 |
| WP_019315370 | 420 | RAIIRRQAEFYPFLAD--NQD RIEKILTFRIPYYVGPL ARGK--SDFAWLSR---KSADKITPWNFDEIVDKES | 486 |
| WP_019803776 | 420 | RAIIRRQAEFYPFLAD--NQD RIEKLLTFRIPYYVGPL ARGK--SDFAWLSR---KSADKITPWNFDEIVDKES | 486 |
| WP_019805234 | 420 | RAIIRRQAEFYPFLAD--NQD RIEKILTFRIPYYVGPL ARGK--SDFAWLSR---KSADKITPWNFDEIVDKES | 486 |
| WP_024783594 | 420 | RAIIRRQAEFYPFLAD--NQD RIEKLLTFRIPYYVGPL ARGK--SDFAWLSR---KSADKITPWNFDEIVDKES | 486 |
| WP_024784288 | 420 | HAILRRQGDYYPFLKE--NQD RIEKILTFRIPYYVGPL ARKN--SRFAWAEY---HSDEAVTPWNFDQVIDKES | 486 |
| WP_024784666 | 420 | RAIIRRQAEFYPFLAD--NQD RIEKILTFRIPYYVGPL ARGK--SDFAWLSR---KSADKITPWNFDEIVDKES | 486 |
| WP_024784894 | 420 | RAIIRRQAEFYPFLAD--NQD RIEKLLTFRIPYYVGPL ASGK--SDFAWLSR---KSADKITPWNFDEIVDKES | 486 |
| WP_024786433 | 420 | HAILRRQGDYYPFLKE--NQD RIEKILTFRIPYYVGPL ARKN--SRFAWAEY---HSDEAVTPWNFDQVIDKES | 486 |
| WP_049473442 | 420 | RAIIRRQAEFYPFLAD--NQD RIEKILTFRIPYYVGPL ARGK--SDFAWLSR---KSADKITPWNFDEIVDKES | 486 |
| WP_049474547 | 420 | RAIIRRQAEFYPFLAD--NQD RIEKLLTFRIPYYVGPL ASGK--SDFAWLSR---KSADKITPWNFDEIVDKES | 486 |
| EMC03581 | 413 | RAIIRRQAEFYPFLAD--NQD RIEKILTFRIPYYVGPL ARGK--SDFAWLSR---KSADKITPWNFDEIVDKES | 479 |
| WP_000428612 | 421 | NAILRRQGEHYPFLKE--NKE KIEKILTFRIPYYVGPL ARGN--RDFAWLTR---NSDQAIRPWNFEEIVDKAS | 487 |
| WP_000428613 | 421 | NAILRRQGEHYPFLKD--NKE KIEKILTFRIPYYVGPL ARGN--RDFAWLTR---NSDEAIRPWNFEEIVDKAS | 487 |
| WP_049523028 | 420 | NAILRHQGEYYPFLKE--NKD KIEQILTFRIPYYVGPL ARGN--SDFAWLSR---NSDEAIRPWNFEEMVDKSS | 486 |
| WP_003107102 | 389 | KSIIRRQEKYYPFLKD--KQV RIEKIFTFRIPYFVGPL ANG-n-SSFAWVKR---RSNESITPWNFEEVVEQEA | 455 |
| WP_054279288 | 422 | QAILERQQAYYPFLKD--NQE KIEKILTFRIPYYIGPL ARG-n-SRFAWLTR---TSDQKITPWNFDEMVDQEA | 488 |
| WP_049531101 | 421 | NAILRRQGEHYPFLKE--NRE KIEKILTFRIPYYVGPL ARGN--RDFAWLTR---NSDQAIRPWNFEEIVDKAS | 487 |
| WP_049538452 | 421 | NAILRRQGEHYPFLKE--NKE KIEKILTFRIPYYVGPL ARGN--RDFAWLTR---NSDQAIRPWNFEEIVDKAS | 487 |

-continued

| | | | |
|---|---|---|---|
| WP_049549711 | 421 | NAILRRQGEHYPFLKE--NKE KIEKILTFRIPYYVGPL ARGN--RDFAWLTR---NSDQAIRPWNFEEIVDKAS | 487 |
| WP_007896501 | 422 | HAILRRQEKYYPFLAE--QKE KIEQLLCFRIPYYVGPL AKGGn-SSFAWLKR---RSDEPITPWNFKDVVDEEA | 489 |
| EFR44625 | 374 | HAILRRQEKYYPFLAE--QKE KIEQLLCFRIPYYVGPL AKGGn-SSFAWLKR---RSDEPITPWNFKDVVDEEA | 441 |
| WP_002897477 | 420 | NAILRRQGEHYPFLKE--NRE KIEKILTFRIPYYVGPL ARDN--RDFSWLTR---NSDEPIRPWNFEEVVDKAR | 486 |
| WP_002906454 | 420 | NAILRRQGEHYLELKE--NRE KIEKILAFRIPYYVGPL ARGN--RDFAWLTR---NSDQAIRPWNFEEVVDKAS | 486 |
| WP_009729476 | 421 | NAILRRQGEHYPFLKE--NKE KIEKILTFRIPYYVGPL ARGN--RDFAWLTR---NSDQAIRPWNFEEIVDKAS | 487 |
| CQR24647 | 421 | KAILRRQGEFYPFLKE--NAE KIQQILTFKIPYYVGPL ARGN--SRFAWASY---NSNEKMTPWNFDNVIDKTS | 487 |
| WP_000066813 | 421 | NAIIRRQGEHYPFLQE--NKE KIEKILTFRIPYYVGPL ARGN--GDFAWLTR---NSDQAIRPWNFEEIVDQAS | 487 |
| WP_009754323 | 421 | NAILRRQGEHYPLLKE--NKE KIEKILTFRIPYYVGPL ARGN--RDFAWLTR---NSDQAIRPWNFEEIVDKAS | 487 |
| WP_044674937 | 420 | HAIIRRQAEFYPFLVE--NQD KIEKILTFRIPYYVGPL ARGK--SEFAWLNR---KSDEKIRPWNFDEMVDKET | 486 |
| WP_044676715 | 420 | HAIIRRQAEFYPFLVE--NQD KIEKILTFRIPYYVGPL ARGK--SEFAWLNR---KSDEKIRPWNFDEMVDKET | 486 |
| WP_044680361 | 420 | HAIIRRQAEFYPFLVE--NQD KIEKILTFRIPYYVGPL ARGK--SEFAWLNR---KSDEKIRPWNFDEMVDKET | 486 |
| WP_044681799 | 420 | HAIIRRQAEFYPFLVE--NQD KIEKILTFRIPYYVGPL ARGK--SEFAWLNR---KSDEKIRPWNEDMVDKET | 486 |
| WP_049533112 | 420 | HAILRRQEEHYPFLKE--NQD KIEKILTFRIPYYVGPL ARKG--SRFAWAEY---KADEKITPWNEDDILDKEK | 486 |
| WP_029090905 | 404 | VAILENQATYYPFLLE--QKD NIHKLLTFRIPYYVGPL ADQKd-SEFAWMVR---KQAGKITPFNFEEMVDIDA | 471 |
| WP_006506696 | 430 | IKIIDNQAEYYPILKE--KRE QLLSILTFRIPYYFGPL ETSEh----AWIKRlegKENQRILPWNYQDIVDVDA | 498 |
| AIT42264 | 420 | HAILRRQEDFYPFLKD--NRE KIEKILTFRIPYYVGPL ARG-n-SRFAWMTR---KSEETITPWNFEEVVDKGA | 486 |
| WP_034440723 | 426 | TAVLDQQEKHYSFLKE--NRD KIISLLTFRIPYYVGPL AKGE--SRFAWLER--sNSEEKIKPWNEDKIVDIDK | 493 |
| AKQ21048 | 420 | HAILRRQEDFYPFLKD--NRE KIEKILTFRIPYYVGPL ARG-n-SRFAWMTR---KSEETITPWNFEEVVDKGA | 486 |
| WP_004636532 | 421 | QAILDRQSQYYPFLAE--NRD KIESLVTFRIPYYVGPL TVSDq-SEFAWMER---QSDEPIRPWNEDEIVNKER | 488 |
| WP_002364836 | 428 | QAIIHRQAAYYPFLKE--NQE KIEQLVTFRIPYYVGPL SKGDa-STFAWLKR---QSEEPIRPWNLQETVDLDQ | 495 |
| WP_016631044 | 379 | QAIIHRQAAYYPFLKE--NQE KIEQLVTFRIPYYVGPL SKGDa-STFAWLKR---QSEEPIRPWNLQETVDLDQ | 446 |
| EMS75795 | 163 | KAIIERQKPYYPSLEE--ARD KMIRLLTFRIPYYVGPL AQGEetSSFAWLER---KTPEKVTPWNATEVIDYSA | 231 |
| WP_002373311 | 428 | QAIIHRQAAYYPFLKE--NQE KIEQLVTFRIPYYVGPL SKGDa-STFAWLKR---QSEEPIRPWNLQETVDLDQ | 495 |
| WP_002378009 | 428 | QAIIHRQAAYYPFLKE--NQE KIEQLVTFRIPYYVGPL SKGDa-NTFAWLKR---QSEEPIRPWNLQETVDLDQ | 495 |
| WP_002407324 | 428 | QAIIHRQAAYYPFLKE--NQE KIEQLVTFRIPYYVGPL SKGDa-STFAWLKR---QSEEPIRPWNLQETVDLDQ | 495 |
| WP_002413717 | 428 | QAIIHRQAAYYPFLKE--NQE KIEQLVTFRIPYYVGPL SKGDa-STFAWLKR---QSEEPIRPWNLQETVDLDQ | 495 |
| WP_010775580 | 430 | QAIIHRQAAYYPFLKE--NQK KIEQLVTFRIPYYVGPL SKGDa-STFAWLKR---QSEEPIRPWNLQETVDLDQ | 497 |
| WP_010818269 | 428 | QAIIHRQAAYYPFLKE--NQE KIEQLVTFRIPYYVGPL SKGDa-STFAWLKR---QSEEPIRPWNLQETVDLDQ | 495 |
| WP_010824395 | 428 | QAIIHRQAAYYPFLKE--NQE KIEQLVTFRIPYYVGPL SKGDa-STFAWLKR---QSEEPIRPWNLQETVDLDQ | 495 |
| WP_016622645 | 428 | QAIIHRQAAYYPFLKE--NQE KIEQLVTFRIPYYVGPL SKGDa-STFAWLKR---QSEEPIRPWNLQETVDLDQ | 495 |
| WP_033624816 | 428 | QAIIHRQAAYYPFLKE--NQK KIEQLVTFRIPYYVGPL SKGDa-STFAWLKR---QSEEPIRPWNLQETVDLDQ | 495 |
| WP_033625576 | 428 | QAIIHRQAAYYPFLKE--NQE KIEQLVTFRIPYYVGPL SKGDa-STFAWLKR---QNEKPIRPWNLQETVDLDQ | 495 |
| WP_033789179 | 428 | QAIIHRQAAYYPFLKE--NQK KIEQLVTFRIPYYVGPL SKGDa-STFAWLKR---QSEEPIRPWNLQETVDLDQ | 495 |
| WP_002310644 | 424 | RAIIANQKKHYPFLKE--EQE KLESLLTFKIPYYVGPL AKKQenSPFAWLIR---KSEEKIKPWNLPEIVDMEG | 492 |
| WP_002312694 | 425 | RAIIANQKKHYPFLKE--EQE KLESLLTFKIPYYVGPL AKKQenSPFAWLIR---KSEEKIKPWNLPEIVDMEG | 493 |
| WP_002314015 | 425 | RAIIANQKKHYPFLKE--EQE KLESLLTFKIPYYVGPL AKKQenSPFAWLIR---KSEEKIKPWNLPEIVDMEG | 493 |
| WP_002320716 | 425 | RAIIANQKKHYPFLKE--EQE KLESLLTFKIPYYVGPL AKKQenSPFAWLIR---KSEEKIKPWNLPEIVDMEG | 493 |
| WP_002330729 | 424 | RAIIANQKKHYPFLKE--EQE KLESLLTFKIPYYVGPL AKKQenSPFAWLIR---KSEEKIKPWNLPEIVDMEG | 492 |
| WP_002335161 | 425 | RAIIANQKKHYPFLKE--EQE KLESLLTFKIPYYVGPL AKKQenSPFAWLIR---KSEEKIKPWNLPEIVDMEG | 493 |
| WP_002345439 | 425 | RAIIANQKKHYPFLKE--EQE KLESLLTFKIPYYVGPL AKKQenSPFAWLIR---KSEEKIKPWNLPEIVDMEG | 493 |

-continued

```
WP_034867970    418 KAIIDQQKQHYPFLEE--AGP KIIALFKFRIPYYVGPL AKEQeaSSFAWIER---KTAEKINPWNFSEVVDIEK    486
WP_047937432    425 RAIIANQKKHYPFLKE--EQE KLESLLTFKIPYYVGPL AKKQenSPFAWLIR---KSEEKIKPWNLPEIVDMEG    493
WP_010720994    418 KAIIDQQKQHYPFLEE--AGP KIIALFKFRIPYYVGPL AKEQeaSSFAWIER---KTAEKINPWNFSEVVDIEK    486
WP_010737004    418 KAIIDQQKQHYPFLEE--AGP KIIALFKFRIPYYVGPL AKEQeaSSFAWIER---KTAEKINPWNFSEVVDIEK    486
WP_034700478    418 KAIIDQQKQHYPFLEE--AGP KIIALFKFRIPYYVGPL AKEQeaSSFAWIER---KTAEKINPWNFSEVVDIEK    486
WP_007209003    422 RAILRKQEKYYSFLKE--NHE KIEQIFKVRIPYYVGPL AKHNeqSRFAWNIR---KSDEPIRPWNMNDVVDENA    490
WP_023519017    418 REIMDRQKRFYPFLKG--AQG KIEKLLTFRIPYYVGPL AQEGq-SPFAWIKR---KSPSQITPWNFAEVVDKEN    485
WP_010770040    423 EAIIQKQATYYPFLAD--NKE EMKQLVTFRIPYYVGPL ADGN--SPFAWLER---ISSEPIRPGNLAEVVDIKK    489
WP_048604708    419 KAILHHQAMYYPFLQE--KFS NFVDLLTFRIPYYVGPL ANGN--SRFSWLSR---KSDEPIRPWNLAEVVDLSK    485
WP_010750235    418 KAIIDQQKQYYPFLEK--SKE KMIQLLTFRIPYYVGPL AQDKetSSFAWLER---KTTEKIKPWNAKDVIDYGA    486
AII16583        459 HAILRRQEDFYPFLKD--NRE KIEKILTFRIPYYVGPL ARG-n-SRFAWMTR---KSEETITPWNFEEVVDKGA    525
WP_029073316    436 NKILENQSVYYSDLKD--NED KIRSILTFRIPYYFGPL ITKDr--QFDWIIKkegKENERILPWNANEIVDVDK    506
WP_031589969    436 NKILENQSVYYSDLKD--NED KIRSILTFRIPYYFGPL ITKDr--QFDWIIKkegKENERILPWNANEIVDVDK    506
KDA45870        418 VAIVENQGKYYPFLRE--NKD KFEKILNFRIPYYVGPL ARGN--SKFAWLTR--a-GEGKITPYNFDEMIDKET    484
WP_039099354    426 DRIIENQQQYYPWLAE-lNPN KLDELVAFRVPYYVGPL QQQSsdAKFAWMIR---KAEGQITPWNFDDKVDRQA    509
AKP02966        416 EKIIDNQSQYYPFLKE--NKE KLLSILSFRIPYYVGPL -QSSekNPFAWMER---KSNGHARPWNFDEIVDREK    483
WP_010991369    426 EAILHQQAKYYPFLKE--NYD KIKSLVTFRIPYFVGPL ANGQ--SEFAWLTR---KADGEIRPWNIEEKVDEGK    492
WP_033838504    426 EAILHQQAKYYPFLKE--NYD KIKSLVTFRIPYFVGPL ANGQ--SEFAWLTR---KADGEIRPWNIEEKVDFGK    492
EHN60060        429 EAILHQQAKYYPFLKE--NYD KIKSLVTFRIPYFVGPL ANGQ--SEFAWLTR---KADGEIRPWNIEEKVDFGK    495
EFR89594        195 EAILHQQAKYYPFLKE--NYD KIKSLVTFRIPYFVGPL ANGQ--SEFAWLTR---KADGEIRPWNIEEKVDFGK    261
WP_038409211    426 EAILHQQAKYYPFLRK--DYE KIRSLVTFRIPYFIGPL ANGQ--SDFAWLTR---KADGEIRPWNIEEKVDFGK    492
EFR95520         45 EAILHQQAKYYPFLRK--DYE KIRSLVTFRIPYFIGPL ANGQ--SDFAWLTR---KADGEIRPWNIEEKVDFGK    111
WP_003723650    426 EAIIHQQAKYYPFLKE--DYD KIKSLVTFRIPYFVGPL ANGQ--SEFAWLTR---KADGEIRPWNIEEKVDFGK    492
WP_003727705    426 EAILHQQAKYYPFLRE--GYD KIKSLVTFRIPYFVGPL ANGQ--SEFAWLTR---KDDGEIRPWNIEEKVDFGK    492
WP_003730785    426 EAILHQQAKYYPFLRE--GYD KIKSLVTFRIPYFVGPL ANGQ--SEFAWLTR---KDDGEIRPWNIEEKVDFGK    492
WP_003733029    426 EAILHQQAKYYPFLRE--DYE KIKSLVTFRIPYFVGPL AKGQ--SEFAWLTR---KADGEIRPWNIEEKVDFGK    492
WP_003739838    426 EAILHQQAKYYPFLKE--AYD KIKSLVTFRIPYFVGPL ANGQ--SDFAWLTR---KADGEIRPWNIEEKVDFGK    492
WP_014601172    426 EAIIHQQAKYYPFLRE--DYE KIKSLVTFRIPYFVGPL AKGQ--SEFAWLTR---KADGEIRPWNIEEKVDFGK    492
WP_023548323    426 EAILHQQAKYYPFLRE--DYE KIKSLVTFRIPYFVGPL AKGQ--SEFAWLTR---KADGEIRPWNIEEKVDEGK    492
WP_031665337    426 EAIIHQQAKYYTFLKE--DYD KIKSLVTFRIPYFVGPL ANGQ--SEFAWLTR---KADGEIRPWNIEEKVDFGK    492
WP_031669209    426 EAILHQQAKYYPFLRE--DYE KIKSLVTFRIPYFVGPL AKGQ--SEFAWLTR---KADGEIRPWNIEEKVDFGK    492
WP_033920898    426 EAIIHQQAKYYPFLRE--DYE KIKSLVTFRIPYFVGPL AKGQ--SEFAWLTR---KADGEIRPWNIEEKVDFGK    492
AKI42028        429 EAIIHQQAKYYPFLRE--DYE KIKSLVTFRIPYFVGPL AKGQ--SEFAWLTR---KADGEIRPWNIEEKVDEGK    495
AKI50529        429 EAIIHQQAKYYPFLRE--DYE KIKSLVTFRIPYFVGPL AKGQ--SEFAWLTR---KADGEIRPWNIEEKVDFGK    495
EFR83390            --------------------- ----------------- -----------------------------------
WP_046323366    426 EAILHQQAKYYPFLKV--DYE KIKSLVTFRIPYFVGPL ANGQ--SEFSWLTR---KADGEIRPWNIEEKVDFGK    492
AKE81011        436 HAILRRQEDFYPFLKD--NRE KIEKILTFRIPYYVGPL ARG-n-SRFAWMTR---KSEETITPWNFEEVVDKGA    502
CUO82355        434 IKIIDNQAKYYPVLKE--KRE QLLSILTFRIPYYFGPL ETSEh----AWIKRlegKENQRILPWNYQDTVDVDA    502
WP_033162887    435 IQIIDNQSVYYPQLKE--NRD KLISILEFRIPYYFGPL AHSE----FAWIKKfedKQKERILPWNYDQIVDIDA    503
AGZ01981        453 HAILRRQEDFYPFLKD--NRE KIEKILTFRIPYYVGPL ARG-n-SRFAWMTR---KSEETITPWNFEEVVDKGA    519
```

```
                      -continued
AKA60242      420 HAILRRQEDFYPFLKD--NRE KIEKILTFRIPYYVGPL ARG-n-SRFAWMTR---KSEETITPWNFEEVVDKGA      486

AKS40380      420 HAILRRQEDFYPFLKD--NRE KIEKILTFRIPYYVGPL ARG-n-SRFAWMTR---KSEETITPWNFEEVVDKGA      486

4UN5_B        424 HAILRRQEDFYPFLKD--NRE KIEKILTFRIPYYVGPL ARG-n-SRFAWMTR---KSEETITPWNFEEVVDKGA      490

WP_010922251  487 SAQSFIERMTNFDKNLPNEKVLPKHSLLYEYFTVYNELTKVKYVT--EGMRKPaFLSGEQKKAIVDLLFK--TNR-KVTV      561

WP_039695303  490 SAEKFITRMTLNDLYLPEEKVLPKHSHVYETYAVYNELTKIKYVN--EQGKES-FFDSNMKQEIFDHVFK--ENR-KVTK      563

WP_045635197  487 SAEDFINKMTNYDLYLPEEKVLPKHSLLYETFAVYNELTKVKFIA--EGLRDYqFLDSGQKKQIVNQLFK--ENR-KVTE      561

5AXW_A        230 --KEWYEMLMGHCTYFPEELRSVKYAYNADLYNALNDLNNLVITR--DENEKLeYYE---KFQIIENVFK--QKK-KPTL      299

WP_009880683  171 SAQSFIERMTNFDKNLPNEKVLPKHSLLYEYFTVYNELTKVKYVT--EGMRKPaFLSGEQKKAIVDLLFK--TNR-KVTV      245

WP_010922251  487 SAQSFIERMTNFDKNLPNEKVLPKHSLLYEYFTVYNELTKVKYVT--EGMRKPaFLSGEQKKAIVDLLFK--TNR-KVTV      561

WP_011054416  487 SAQSFIERMTNFDKNLPNEKVLPKHSLLYEYFTVYNELTKVKYVT--EGMRKPaFLSGEQKKAIVDLLFK--TNR-KVTV      561

WP_011284745  487 SAQSFIERMTNFDKNLPNEKVLPKHSLLYEYFTVYNELTKVKYVT--EGMRKPaFLSGEQKKAIVDLLFK--TNR-KVTV      561

WP_011285506  487 SAQSFIERMTNFDKNLPNEKVLPKHSLLYEYFTVYNELTKVKYVT--EGMRKPaFLSGEQKKAIVDLLFK--TNR-KVTV      561

WP_011527619  487 SAQSFIERMTNFDKNLPNEKVLPKHSLLYEYFTVYNELTKVKYVT--EGMRKPaFLSGEQKKAIVDLLFK--TNR-KVTV      561

WP_012560673  487 SAQSFIERMTNFDKNLPNEKVLPKHSLLYEYFTVYNELTKVKYVT--EGMRKPaFLSGEQKKAIVDLLFK--TNR-KVTV      561

WP_014407541  487 SAQSFIERMTNFDKNLPNEKVLPKHSLLYEYFTVYNELTKVKYVT--EGMRKPaFLSGEQKKAIVDLLFK--TNR-KVTV      561

WP_020905136  487 SAQSFIERMTNFDKNLPNEKVLPKHSLLYEYFTVYNELTKVKYVT--EGMRKPaFLSGEQKKAIVDLLFK--TNR-KVTV      561

WP_023080005  487 SAQSFIERMTNFDKNLPNEKVLPKHSLLYEYFTVYNELTKVKYVT--EGMRKPaFLSGEQKKAIVDLLFK--TNR-KVTV      561

WP_023610282  487 SAQSFIERMTNFDKNLPNEKVLPKHSLLYEYFTVYNELTKVKYVT--EGMRKPaFLSGEQKKAIVDLLFK--TNR-KVTV      561

WP_030125963  487 SAQSFIERMTNFDKNLPNEKVLPKHSLLYEYFTVYNELTKVKYVT--EGMRKPaFLSGEQKKAIVDLLFK--TNR-KVTV      561

WP_030126706  487 SAQSFIERMTNFDKNLPNEKVLPKHSLLYEYFTVYNELTKVKYVT--EGMRKPaFLSGEQKKAIVDLLFK--TNR-KVTV      561

WP_031488318  487 SAQSFIERMTNFDKNLPNEKVLPKHSLLYEYFTVYNELTKVKYVT--EGMRKPeFLSGEQKKAIVDLLFK--TNR-KVTV      561

WP_032460140  487 SAQSFIERMTNFDKNLPNEKVLPKHSLLYEYFTVYNELTKVKYVT--EGMRKPaFLSGEQKKAIVDLLFK--TNR-KVTV      561

WP_032461047  487 SAQSFIERMTNFDKNLPNEKVLPKHSLLYEYFTVYNELTKVKYVT--EGMRKPaFLSGEQKKAIVDLLFK--TNR-KVTV      561

WP_032462016  487 SAQSFIERMTNFDKNLPNEKVLPKHSLLYEYFTVYNELTKVKYVT--EGMRKPaFLSGEQKKAIVDLLFK--TNR-KVTV      561

WP_032462936  487 SAQSFIERMTNFDKNLPNEKVLPKHSLLYEYFTVYNELTKVKYVT--EGMRKPaFLSGEQKKAIVDLLFK--TNR-KVTV      561

WP_032464890  487 SAQSFIERMTNFDKNLPNEKVLPKHSLLYEYFTVYNELTKVKYVT--EGMRKPaFLSGEQKKAIVDLLFK--TNR-KVTV      561

WP_033888930  312 SAQSFIERMTNFDKNLPNEKVLPKHSLLYEYFTVYNELTKVKYVT--EGMRKPaFLSGEQKKAIVDLLFK--TNR-KVTV      386

WP_038431314  487 SAQSFIERMTNFDKNLPNEKVLPKHSLLYEYFTVYNELTKVKYVT--EGMRKPaFLSGEQKKAIVDLLFK--TNR-KVTV      561

WP_038432938  487 SAQSFIERMTNFDKNLPNEKVLPKHSLLYEYFTVYNELTKVKYVT--EGMRKPaFLSGEQKKAIVDLLFK--TNR-KVTV      561

WP_038434062  487 SAQSFIERMTNFDKNLPNEKVLPKHSLLYEYFTVYNELTKVKYVT--EGMRKPaFLSGEQKKAIVDLLFK--TNR-KVTV      561

BAQ51233      398 SAQSFIERMTNFDKNLPNEKVLPKHSLLYEYFTVYNELTKVKYVT--EGMRKPaFLSGEQKKAIVDLLFK--TNR-KVTV      472

KGE60162          --------------------------------------------------------------------------

KGE60856          --------------------------------------------------------------------------

WP_002989955  487 SAQSFIERMTNFDKNLPNEKVLPKHSLLYEYFTVYNELTKVKYVT--EGMRKPaFLSGEQKKAIVDLLFK--TNR-KVTV      561

WP_003030002  487 SAEKFITRMTLNDLYLPEEKVLPKHSLLYETFTVYNELTKVKYVN--EQGEAK-FFDANMKQEIFDHVFK--ENR-KVTK      560

WP_003065552  490 SAEKFITRMTLNDLYLPEEKVLPKHSHVYETYAVYNELTKIKYVN--EQGKDS-FFDSNMKQEIFDHVFK--ENR-KVTK      563

WP_001040076  488 SAEAFIHRMTNNDLYLPEEKVLPKHSLIYEKFTVYNELTKVRFLA--EGFKDFqFLNRKQKETIFNSLFK--EKR-KVTE      562

WP_001040078  488 SAEAFIHRMTNNDFYLPEEKVLPKHSLIYEKFTVYNELTKVRYKN--EQGETY-FFDSNIKQEIFDGVFK--EHR-KVSK      561

WP_001040080  488 SAEAFIHRMTNNDFYLPEEKVLPKHSLIYEKFTVYNELTKVRYKN--EQGETY-FFDSNIKQEIFDGVFK--EHR-KVSK      561

WP_001040081  488 SAEAFIHRMTNNDFYLPEEKVLPKHSLIYEKFTVYNELTKVRYKN--EQGETY-FFDSNIKQEIFDGVFK--EHR-KVSK      561
```

-continued

```
WP_001040083    488 SAEAFIHRMTNNDFYLPEEKVLPKHSLIYEKFTVYNELTKVRYKN--EQGETY-FFDSNIKQEIFDGVFK--EHR-KVSK 561

WP_001040085    488 SAEAFIHRMTNNDFYLPEEKVLPKHSLIYEKFTVYNELTKVRYKN--EQGETY-FFDSNIKQEIFDGVFK--EHR-KVSK 561

WP_001040087    488 SAEAFIHRMTNNDFYLPEEKVLPKHSLIYEKFTVYNELTKVRYKN--EQGETY-FFDSNIKQEIFDGVFK--EHR-KVSK 561

WP_001040088    488 SAEAFIHRMTNNDFYLPEEKVLPKHSLIYEKFTVYNELTKVRYKN--EQGETY-FFDSNIKQEIFDGVFK--EHR-KVSK 561

WP_001040089    488 SAEAFIHRMTNNDFYLPEEKVLPKHSLIYEKFTVYNELTKVRYKN--EQGETY-FFDSNIKQEIFDGVFK--EHR-KVSK 561

WP_001040090    488 SAEAFIHRMTNNDFYLPEEKVLPKHSLIYEKFTVYNELTKVRYKN--EQGETY-FFDSNIKQEIFDGVFK--EHR-KVSK 561

WP_001040091    488 SAEAFIHRMTNNDFYLPEEKVLPKHSLIYEKFTVYNELTKVRYKN--EQGETY-FFDSNIKQEIFDGVFK--EHR-KVSK 561

WP_001040092    488 SAEAFIHRMTNNDLYLPEEKVLPKHSLIYEKFTVYNELTKVRYKN--EQGETY-FFDSNVKQEIFDGVFK--EHR-KVSK 561

WP_001040094    488 SAEAFIHRMTNNDLYLPEEKVLPKHSLIYEKFTVYNELTKVRFLA--EGFKDFqFLNRKQKETIFNSLFK--EKR-KVTE 562

WP_001040095    488 SAEAFIHRMTNNDLYLPEEKVLPKHSLIYEKFTVYNELTKVRFLA--EGFKDFqFLNRKQKETIFNSLFK--EKR-KVTE 562

WP_001040096    488 SAEAFIHRMTNNDLYLPEEKVLPKHSLIYEKFTVYNELTKVRFLA--EGFKDFqFLNRKQKETIFNSLFK--EKR-KVTE 562

WP_001040097    488 SAEAFIHRMTNNDLYLPEEKVLPKHSLIYEKFTVYNELTKVRFLA--EGFKDFqFLNRKQKETIFNSLFK--EKR-KVTE 562

WP_001040098    488 SAEAFIHRMTNNDLYLPEEKVLPKHSLIYEKFTVYNELTKVRFLA--EGFKDFqFLNRKQKETIFNSLFK--EKR-KVTE 562

WP_001040099    488 SAEAFIHRMTNNDLYLPEEKVLPKHSLIYEKFTVYNELTKVRFLA--EGFKDFqFLNRKQKETIFNSLFK--EKR-KVTE 562

WP_001040100    488 SAEAFIHRMTNNDLYLPEEKVLPKHSLIYEKFTVYNELTKVRFLA--EGFKDFqFLNRKQKETIFNSLFK--EKR-KVTE 562

WP_001040104    488 SAEAFIHRMTNNDFYLPEEKVLPKHSLIYEKFTVYNELTKVRYKN--EQGETY-FFDSNIKQEIFDGVFK--EHR-KVSK 561

WP_001040105    488 SAEAFIHRMTNNDFYLPEEKVLPKHSLIYEKFTVYNELTKVRYKN--EQGETY-FFDSNIKQEIFDGVFK--EHR-KVSK 561

WP_001040106    488 SAEAFIHRMTNNDFYLPEEKVLPKHSLIYEKFTVYNELTKVRYKN--EQGETY-FFDSNIKQEIFDGVFK--EHR-KVSK 561

WP_001040107    488 SAEAFIHRMTNNDFYLPEEKVLPKHSLIYEKFTVYNELTKVRYKN--EQGETY-FFDSNIKQEIFDGVFK--EHR-KVSK 561

WP_001040108    488 SAEAFIHRMTNNDFYLPEEKVLPKHSLIYEKFTVYNELTKVRYKN--EQGETY-FFDSNIKQEIFDGVFK--EHR-KVSK 561

WP_001040109    488 SAEAFIHRMTNNDFYLPEEKVLPKHSLIYEKFTVYNELTKVRYKN--EQGETY-FFDSNIKQEIFDGVFK--EHR-KVSK 561

WP_001040110    488 SAEAFIHRMTNNDFYLPEEKVLPKHSLIYEKFTVYNELTKVRYKN--EQGETY-FFDSNIKQEIFDGVFK--EHR-KVSK 561

WP_015058523    488 SAEAFIHRMTNNDLYLPEEKVLPKHSLIYEKFTVYNELTKVRYKN--EQGETY-FFDSNVKQEIFDGVFK--EHR-KVSK 561

WP_017643650    488 SAEAFIHRMTNNDLYLPEEKVLPKHSLIYEKFTVYNELTKVRFLA--EGFKDFqFLNRKQKETIFNSLFK--EKR-KVTE 562

WP_017647151    488 SAEAFIHRMTNNDLYLPEEKVLPKHSLIYEKFTVYNELTKVRYKN--EQGETY-FFDSNIKQEIFDGVFK--EHR-KVSK 561

WP_017648376    488 SAEAFIHRMTNNDLYLPEEKVLPKHSLIYEKFTVYNELTKVRYKN--EQGETY-FFDSNIKQEIFDGVFK--EHR-KVSK 561

WP_017649527    488 SAEAFIHRMTNNDFYLPEEKVLPKHSLIYEKFTVYNELTKVRYKN--EQGETY-FFDSNIKQEIFDGVFK--EHR-KVSK 561

WP_017771611    488 SAEAFIHRMTNNDLYLPEEKVLPKHSLIYEKFTVYNELTKVRYKN--EQGETY-FFDSNIKQEIFDGVFK--EHR-KVSK 561

WP_017771984    488 SAEAFIHRMTNNDFYLPEEKVLPKHSLIYEKFTVYNELTKVRYKN--EQGETY-FFDSNIKQEIFDGVFK--EHR-KVSK 561

CFQ25032        488 SAEAFIHRMTNNDFYLPEEKVLPKHSLIYEKFTVYNELTKVRYKN--EQGETY-FFDSNIKQEIFDGVFK--EHR-KVSK 561

CFV16040        488 SAEAFIHRMTNNDFYLPEEKVLPKHSLIYEKFTVYNELTKVRYKN--EQGETY-FFDSNIKQEIFDGVFK--EHR-KVSK 561

KLJ37842        488 SAEAFIHRMTNNDFYLPEEKVLPKHSLIYEKFTVYNELTKVRYKN--EQGETY-FFDSNIKQEIFDGVFK--EHR-KVSK 561

KLJ72361        488 SAEAFIHRMTNNDFYLPEEKVLPKHSLIYEKFTVYNELTKVRYKN--EQGETY-FFDSNIKQEIFDGVFK--EHR-KVSK 561

KLL20707        488 SAEAFIHRMTNNDFYLPEEKVLPKHSLIYEKFTVYNELTKVRYKN--EQGETY-FFDSNIKQEIFDGVFK--EHR-KVSK 561

KLL42645        488 SAEAFIHRMTNNDLYLPEEKVLPKHSLIYEKFTVYNELTKVRYKN--EQGETY-FFDSNIKQEIFDGVFK--EHR-KVSK 561

WP_047207273    488 SAEAFIHRMTNNDFYLPEEKVLPKHSLIYEKFTVYNELTKVRYKN--EQGETY-FFDSNIKQEIFDGVFK--EHR-KVSK 561

WP_047209694    488 SAEAFIHRMTNNDLYLPEEKVLPKHSLIYEKFTVYNELTKVRFLA--EGFKDFqFLNRKQKETIFNSLFK--EKR-KVTE 562

WP_050198062    488 SAEAFIHRMTNNDFYLPEEKVLPKHSLIYEKFTVYNELTKVRYKN--EQGETY-FFDSNIKQEIFDGVFK--EHR-KVSK 561

WP_050201642    488 SAEAFIHRMTNNDFYLPEEKVLPKHSLIYEKFTVYNELTKVRYKN--EQGETY-FFDSNIKQEIFDGVFK--EHR-KVSK 561

WP_050204027    488 SAEAFIHRMTNNDLYLPEEKVLPKHSLIYEKFTVYNELTKVRYKN--EQGETY-FFDSNIKQEIFDGVFK--EHR-KVSK 561

WP_050881965    488 SAEAFIHRMTNNDFYLPEEKVLPKHSLIYEKFTVYNELTKVRYKN--EQGETY-FFDSNIKQEIFDGVFK--EHR-KVSK 561
```

```
-continued

WP_050886065  488 SAEAFIHRMTNNDFYLPEEKVLPKHSLIYEKFTVYNELTKVRYKN--EQGETY-FFDSNIKQEIFDGVFK--EHR-KVSK 561
AHN30376      488 SAEAFIHRMTNNDLYLPEEKVLPKHSLIYEKFTVYNELTKVRYKN--EQGETY-FFDSNVKQEIFDGVFK--EHR-KVSK 561
EAO78426      488 SAEAFIHRMTNNDFYLPEEKVLPKHSLIYEKFTVYNELTKVRYKN--EQGETY-FFDSNIKQEIFDGVFK--EHR-KVSK 561
CCW42055      488 SAEAFIHCMTNNDLYLPEEKVLPKHSLIYEKFTVYNELTKVRYKN--EQGETY-FFDSNIKQEIFDGVFK--EYR-KVSK 561
WP_003041502  487 SAEKFITRMTLNDLYLPEEKVLPKHSLLYETFTVYNELTKVKYVN--EQGEAK-FFDANMKQEIFDHVFK--ENR-KVTK 560
WP_037593752  488 SAEKFITRMTLNDLYLPEEKVLPKHSPLYETFTVYNELTKVKYVN--EQGEAK-FFDTNMKQEIFDHVFK--ENR-KVTK 561
WP_049516684  488 SAEKFITRMTLNDLYLPEEKVLPKHSPLYETFTVYNELTKVKYVN--EQGEAK-FFDTNMKQEIFDHVFK--ENR-KVTK 561
GAD46167      487 SAEKFITRMTLNDLYLPEEKVLPKHSPLYETFTVYNELTKVKYVN--EQGEAK-FFDTNMKQEIFDHVFK--ENR-KVTK 560
WP_018363470  488 SAEKFITRMTLNDLYLPEEKVLPKHSHVYETFAVYNELTKVKYVN--EQGKDS-FFDSNMKQEIFDHVFK--ENR-KVTK 561
WP_003043819  497 SAQSFIERMTNFDEQLPNKKVLPKHSLLYEYFTVYNELTKVKYVT--ERMRKPeFLSGEQKKAIVDLLFK---TNR-KVTV 571
WP_006269658  487 SAEKFITRMTLNDLYLPEEKVLPKHSPLYEAFTVYNELTKVKYVN--EQGEAK-FFDTNMKQEIFDHVFK--ENR-KVTK 560
WP_048800889  487 SAEKFITRMTLNDLYLPEEKVLPKHSLLYEIFTVYNELTKVKYVN--EQGEAK-FFDANMKQEIFDHVFK--ENP-KVTK 560
WP_012767106  487 SAQSFIERMTNFDKNLPNEKVLPKHSLLYEYFTVYNELTKVKYVT--EGMRKPeFLSGKQKEAIVDLLFK---TNR-KVTV 561
WP_014612333  487 SAQSFIERMTNFDKNLPNEKVLPKHSLLYEYFTVYNELTKVKYVT--EGMRKPeFLSGKQKEAIVDLLFK---TNR-KVTV 561
WP_015017095  487 SAQSFIERMTNFDKNLPNEKVLPKHSLLYEYFTVYNELTKVKYVT--EGMRKPeFLSGKQKEAIVDLLFK---TNR-KVTV 561
WP_015057649  487 SAQSFIERMTNFDKNLPNEKVLPKHSLLYEYFTVYNELTKVKYVT--EGMRKPeFLSGKQKEAIVDLLFK---TNR-KVTV 561
WP_048327215  487 SAQSFIERMTNFDKNLPNEKVLPKHSLLYEYFTVYNELTKVKYVT--EGMRKPeFLSGKQKEAIVDLLFK---TNR-KVTV 561
WP_049519324  487 SAQSFIERMTNFDKNLPNEKVLPKHSLLYEYFTVYNELTKVKYVT--EGMRKPaFLSGEQKKAIVDLLFK---TNR-KVTV 561
WP_012515931  487 SAQIFIEKMTKNDLYLPNEKVLPKHSLLYETFTVYNELTKVKYAT--EGMTRPqFLSADQKQAIVDLLFK---TNR-KVTV 561
WP_021320964  487 SAQIFIEKMTKNDLYLPNEKVLPKHSLLYETFTVYNELTKVKYAT--EGMTRPqFLSADQKQAIVDLLFK---TNR-KVTV 561
WP_037581760  487 SAQIFIEKMTKNDLYLPNEKVLPKHSLLYETFTVYNELTKVKYAT--EGMTRPqFLSADQKQAIVDLLFK---TNR-KVTV 561
WP_004232481  487 SAEKFITRMTLNDLYLPEEKVLPKHSYVYETFAVYNELTKIKYVN--EQGKSF-FFDANMKQEIFDHVFK--ENR-KVTK 560
WP_009854540  488 SAEKFITRMTLNDLYLPEEKVLPKHSHVYETYAVYNELTKIKYVN--EQGKES-FFDSNMKQEIFDHVFK--ENR-KVTK 561
WP_012962174  488 SAEKFITRMTLNDLYLPEEKVLPKHSLVYETYTVYNELTKVKYVN--EQGKSN-FFDANMKQEIFEHVFK--ENR-KVTK 561
WP_039695303  490 SAEKFITRMTLNDLYLPEEKVLPKHSHVYETYAVYNELTKIKYVN--EQGKES-FFDSNMKQEIFDHVFK--ENR-KVTK 563
WP_014334983  487 SAEKFITRMTLNDLYLPEEKVLPKHSHVYETFTVYNELTKIKYVN--EQGESF-FFDANMKQEIFDHVFK--ENR-KVTK 560
WP_003099269  487 SARAFIERMTNFDTYLPEEKVLPKHSPLYEMFMVYNELTKVKYQT--EGMKRPvFLSSEDKEEIVNLLFK--KER-KVTV 561
AHY15608      487 SARAFIERMTNFDTYLPEEKVLPKHSPLYEMFMVYNELTKVKYQT--EGMKRPvFLSSEDKEEIVNLLFK--KER-KVTV 561
AHY17476      487 SARAFIERMTNFDTYLPEEKVLPKHSPLYEMFMVYNELTKVKYQT--EGMKRPvFLSSEDKEEIVNLLFK--KER-KVTV 561
ESR09100          ----------------------------------------------------------------------
AGM98575      487 SARAFIERMTNFDTYLPEEKVLPKHSPLYEMFMVYNELTKVKYQT--EGMKRPvFLSSEDKEEIVNLLFK--KER-KVTV 561
ALF27331      487 SAEAFINRMTNYDLYLPNQKVLPRHSLLYEKFTVYNELTKVKYKT--EQGKTA-FFDANMKQEIFDGVFK--VYR-KVTK 560
WP_018372492  500 SASRFIERMTLHDLYLPDEKVLPRHSLIYEKYTVENELTKVRFTP--EGGKEV-YFSKTDKENIFDSLFK--RYR-KVTK 573
WP_045618028  488 SAEDFINKMTNYDLYLPEEKVLPKHSLLYETFAVYNELTKVKFIA--EGLRDYqFLDSGQKQQIVTQLFK--EKR-KVTE 562
WP_045635197  487 SAEDFINKMTNYDLYLPEEKVLPKHSLLYETFAVYNELTKVKFIA--EGLRDYqFLDSGQKKQIVNQLFK--ENR-KVTE 561
WP_002263549  487 SAEAFINRMTNYDLYLPNQKVLPKHSLLYEKFTVYNELTKVKYKT--EQGKTA-FFDANMKQEIFDGVFK--VYR-KVTK 560
WP_002263887  487 SAEAFINRMTNYDLYLPNQKVLPKHSLLYEKFTVYNELIKVKYKT--EQGKTA-FFDANMKQEIFDGVFK--VYR-KVTK 560
WP_002264920  487 SVEAFINRMTNYDLYLPNQKVLPKHSLLYEKFTVYNELTKVKYKT--EQGKTA-FFDANMKQEIFDGVFK--VYR-KVTK 560
WP_002269043  487 SVEAFINRMTNYDLYLPNQKVLPKHSLLYEKFTVYNELTKVKYKT--EQGKTA-FFDANMKQEIFDGVFK--VYR-KVTK 560
WP_002269448  487 SAEAFINRMTNYDLYLPNQKVLPKHSLLYEKFTVYNELTKVKYKT--EQGKTA-FFDANMKQEIFDGVFK--VYR-KVTK 560
```

```
WP_002271977     487 SAEAFINRMTNYDLYLPNQKVLPKHSLLYEKFTVYNELTKVKYKT--EQGKTA-FFDANMKQEIFDGVFK--VYR-KVTK 560
WP_002272766     487 SAEAFINRMTNYDLYLPNQKVLPKHSLLYEKFTVYNELTKVKYKT--EQGKTA-FFDANMKQEIFDGVFK--VYR-KVTK 560
WP_002273241     487 SAEAFINRMTNYDLYLPNQKVLPKHSLLYEKFTVYNELTKVKYKT--EQGKTA-FFDANMKQEIFDGVFK--VYR-KVTK 560
WP_002275430     487 SAEAFINRMTNYDLYLPNQKVLPKHSLLYEKFTVYNELTKVKYKT--EQGKTA-FFDANMKQEIFDGVFK--VYR-KVTK 560
WP_002276448     487 SAEAFINRMTNYDLYLPNQKVLPKHSLLYEKFTVYNELTKVKYKT--EQGKTA-FFDANMKQEIFDGVFK--VYR-KVTK 560
WP_002277050     487 SAQAFIEHMTNNDLYLPNEKVLPKHSPLYEKYTVYNELTKIKYVT--EIGEAK-FFDANLKQEIFDGLFK--HER-KVTK 560
WP_002277364     487 SAEAFINRMTNYDLYLPNQKVLPKHSLLYEKFTVYNELTKVKYKT--EQGKTA-FFDANMKQEIFDGVFK--VYR-KVTK 560
WP_002279025     487 SAEAFINRMTNYDLYLPNQKVLPKHSLLYEKFTVYNELTKVKYKT--EQGETA-FFDANMKQEIFDGVFK--VYR-KVTK 560
WP_002279859     487 SVEAFINRMTNYDLYLPNQKVLPKHSLLYEKFTVYNELTKVKYKT--EQGKTA-FFDANMKQEIFDGVFK--VYR-KVTK 560
WP_002280230     487 SAEAFINRMTNYDLYLPNQKVLPKHSLLYEKFTVYNELTKVKYKT--EQGKTA-FFDANMKQEIFDGVFK--VYR-KVTK 560
WP_002281696     487 SAEAFINRMTNYDLYLPNQKVLPKHSLLYEKFTVYNELTKVKYKT--EQGKTA-FFDANMKQEIFDGVFK--VYR-KVTK 560
WP_002282247     487 SAQAFIEHMTNNDLYLPNEKVLPKHSPLYEKYTVYNELTKIKYVT--EIGEAK-FFDANLKQEIFDGLFK--HER-KVTK 560
WP_002282906     487 SAEAFINRMTNYDLYLPNQKVLPKHSLLYEKFTVYNELTKVKYKT--EQGKTA-FFDANMKQEIFDGVFK--VYR-KVTK 560
WP_002283846     487 SVEAFINRMTNYDLYLPNQKVLPKHSLLYEKFTVYNELTKVKYKT--EQGKTA-FFDANMKQEIFDGVFK--VYR-KVTK 560
WP_002287255     487 SAEAFINRMTNYDLYLPNQKVLPKHSLLYEKFTVYNELTKVKYKT--EQGKTA-FFDANMKQEIFDGVFK--VYR-KVTK 560
WP_002288990     487 SVEAFINRMTNYDLYLPNQKVLPKHSLLYEKFTVYNELTKVKYKT--EQGKTA-FFDANMKQEIFDGVFK--VYR-KVTK 560
WP_002289641     487 SAEAFINRMTNYDLYLPNQKVLPKHSLLYEKFTVYNELTKVKYKT--EQGKTA-FFDANMKQEIFDGVFK--VYR-KVTK 560
WP_002290427     487 SAEAFINRMTNYDLYLPNQKVLPKHSLLYEKFTVYNELTKVKYKT--EQGKTA-FFDANMKQEIFDGVFK--VYR-KVTK 560
WP_002295753     487 SAEAFINRMTNYDLYLPNQKVLPKHSLLYEKFTVYNELTKVKYKT--EQGKTA-FFDANMKQEIFDGVFK--VYR-KVTK 560
WP_002296423     487 SVEAFINRMTNYDLYLPNQKVLPKHSLLYEKFTVYNELTKVKYKT--EQGKTA-FFDANMKQEIFDGVFK--VYR-KVTK 560
WP_002304487     497 SAEKFITRMTLNDLYLPEEKVLPKHSLLYETFTVYNELTKVKYVN--EQGEAK-FFDANMKQEIFDHVFK--ENR-KVTK 570
WP_002305844     487 SAEAFINRMTNYDLYLPNQKVLPKHSLLYEKFTVYNELTKVKYKT--EQGKTA-FFDANMKQEIFDGVFK--VYR-KVTK 560
WP_002307203     487 SVEAFINRMTNYDLYLPNQKVLPKHSLLYEKFTVYNELTKVKYKT--EQGKTA-FFDANMKQEIFDGVFK--VYR-KVTK 560
WP_002310390     487 SAEAFINRMTNYDLYLPNQKVLPKHSLLYEKFTVYNELTKVKYKT--EQGKTA-FFDANMKQEIFDGVFK--VYR-KVTK 560
WP_002352408     487 SAEAFINRMTNYDLYLPNQKVLPKHSLLYEKFTVYNELTKVKYKT--EQGKTA-FFDANMKQEIFDGVFK--VYR-KVTK 560
WP_012997688     487 SAEAFINRMTNYDLYLPNQKVLPKHSLLYEKFTVYNELTKVKYKT--EQGKTA-FFDANMKQEIFDGVFK--VYR-KVTK 560
WP_014677909     487 SVEAFINRMTNYDLYLPNQKVLPKHSLLYEKFTVYNELTKVKYKT--EQGKTA-FFDANMKQEIFDGVFK--VYR-KVTK 560
WP_019312892     487 SAEAFINRMTNYDLYLPNQKVLPKHSLLYEKFTVYNELTKVKYKT--EQGKTA-FFDANMKQEIFDGVFK--VYR-KVTK 560
WP_019313659     487 SAEAFINRMTNYDLYLPNQKVLPKHSLLYEKFTVYNELTKVKYKT--EQGKTA-FFDANMKQEIFDGVFK--VYR-KVTK 560
WP_019314093     487 SVEAFINRMTNYDLYLPNQKVLPKHSLLYEKFTVYNELTKVKYKT--EQGKTA-FFDANMKQEIFDGVFK--VYR-KVTK 560
WP_019315370     487 SAEAFINRMTNYDLYLPNQKVLPKHSLLYEKFTVYNELTKVKYKT--EQGKTA-FFDANMKQEIFDGVFK--VYR-KVTK 560
WP_019803776     487 SAEAFINRMTNYDLYLPNQKVLPKHSLLYEKFTVYNELTKVKYKT--EQGKTA-FFDANMKQEIFDGVFK--VYR-KVTK 560
WP_019805234     487 SAEAFINRMTNYDLYLPNQKVLPKHSLLYEKFTVYNELTKVKYKT--EQGKTA-FFDANMKQEIFDGVFK--VYR-KVTK 560
WP_024783594     487 SAEAFINRMTNYDLYLPNQKVLPKHSLLYEKFTVYNELTKVKYKT--EQGKTA-FFDANMKQEIFDGVFK--VYR-KVTK 560
WP_024784288     487 SAQAFIEHMTNNDLYLPNEKVLPKHSPLYEKYTVYNELTKIKYVT--EIGEAK-FFDANLKQEIFDGLFK--HER-KVTK 560
WP_024784666     487 SAEAFINRMTNYDLYLPNQKVLPKHSLLYEKFTVYNELTKVKYKT--EQGKTA-FFDANMKQEIFDGVFK--VYR-KVTK 560
WP_024784894     487 SAEAFINRMTNYDLYLPNQKVLPKHSLLYEKFTVYNELTKVKYKT--EQGKTA-FFDANMKQEIFDGVFK--VYR-KVTK 560
WP_024786433     487 SAQAFIEHMTNNDLYLPNEKVLPKHSPLYEKYTVYNELTKIKYVT--EIGEAK-FFDANLKQEIFDGLFK--HER-KVTK 560
WP_049473442     487 SAEAFINRMTNYDLYLPNQKVLPKHSLLYEKFTVYNELTKVKYKT--EQGKTA-FFDANMKQEIFDGVFK--VYR-KVTK 560
WP_049474547     487 SAEAFINRMTNYDLYLPNQKVLPKHSLLYEKFTVYNELTKVKYKT--EQGKTA-FFDANMKQEIFDGVFK--VYR-KVTK 560
EMC03581         480 SAEAFINRMTNYDLYLPNQKVLPKHSLLYEKFTVYNELTKVKYKT--EQGKTA-FFDANMKQEIFDGVFK--VYR-KVTK 553
```

-continued

```
WP_000428612  488 SAESFINKMTNYDLYLPEEKVLPKHSLLYETFAVYNELTKVKFIA--EGLRDYqFLDSRQKKDIFYTLFKaeDKR-KVTE 564
WP_000428613  488 SAEDFINKMTNYDLYLPEEKVLPKHSLLYETFAVYNELTKVKFIA--EGLRDYqFLDSGQKKQIVTQLFK--EKR-KVTE 562
WP_049523028  487 SAEDFIHRMTNYDLYLPEEKVLPKHSLLYETFTVYNELTKVKYIA--EGMKDYqFLDSGQKKQIVNQLFK--EKR-KVTE 561
WP_003107102  456 SAKVFIERMTNFDTYLPEEKVLPKHSLLYEMFTVYNELTKVKYQA--EGMRKPeFLSSEEKIEIVSNLFK--TER-KVTV 530
WP_054279288  489 SAQAFIERMTNFDEYLPQEKVLPKHSLTYEYFTVYNELTKVKYVT--EGMTKPeFLSAGQKEQIVELLFK--KYR-KVTV 563
WP_049531101  488 SAEAFINKMTNYDLYLPEEKVLPKHSLLYETFAVYNELTKVKFIA--EGLRDYqFLDSGQKKKIINQLFK--EKR-KVTE 562
WP_049538452  488 SAEDFINKMTNYDLYLPEEKVLPKHSLLYETFAVYNELTKVKFIA--EGLRDYqFLDSGQKKQIVNQLFK--EKR-KVTE 562
WP_049549711  488 SAEDFINKMTNYDLYLPEEKVLPKHSLLYETFAVYNELTKVKFIA--EGLRDYqFLDSGQKKQIVNQLFK--EKR-KVTE 562
WP_007896501  490 SAQAFIEGMTNYDTYLPEEKVLPKHSPLYEMFTVYNELTKVKYIA--ENMTKPLYLSAEQKEAIIDHLFK--QTR-KVTV 564
EFR44625      442 SAQAFIEGMTNYDTYLPEEKVLPKHSPLYEMFTVYNELTKVKYIA--ENMTKPLYLSAEQKEAIIDHLFK--QTR-KVTV 516
WP_002897477  487 SAEDFIHRMTNYDLYLPEEKVLPKHSLLYETFAVYNELTKVKFIA--EGLRDYqFLDSGQKKQIVNQLFK--EKR-KVTE 561
WP_002906454  487 SAEDFINKMTNYDLYLPEEKVLPKHSLLYETFAVYNELTKVKFIA--EGLRDYqFLDSGQKKQIVNQLFK--DKR-KVTE 561
WP_009729476  488 SAEDFINKMTNYDLYLPEEKVLPKHSLLYETFAVYNELTKVKFIA--EGLRDYqFLDSGQKKQIVTQLFK--EKR-KVTE 562
CQR24647      488 SAQAFIERMTNNDLYLPDQKVLPKHSLLYQKFAVYNELTKIKYVT--ETGEAR-LFDVELKKEIFDGLFK--KER-KVTK 561
WP_000066813  488 SAEDFINKMTNYDLYLPEEKVLPKHSLLYETFAVYNELTKVKFIA--EGLTRYqFLDKKQKKDIFDTFFKaeNKR-KVTE 564
WP_009754323  488 SAESFINKMTNYDLYLPEEKVLPKHSLLYETFAVYNELTKVKFIA--EGLRDYqFFDSGQKKQIVNQLFK--EKR-KVTE 562
WP_044674937  487 SAENFITRMTNYDQYLPDQKVLPKHSLLYEKFAVYNELTKVKFIA--EGMRDYqFLDSGQKKDIVKTLFK--TKR-KVTA 561
WP_044676715  487 SAENFITRMTNYDQYLPDQKVLPKHSLLYEKFAVYNELTKVRYVT--EQGKSF-FFDANMKQEIFDGVFK--VYR-KVTK 560
WP_044680361  487 SAENFITRMTNYDQYLPDQKVLPKHSLLYEKFAVYNELTKVRYVT--EQGKSF-FFDANMKQEIFDGVFK--VYR-KVTK 560
WP_044681799  487 SAENFITRMTNYDQYLPDQKVLPKHSLLYEKFAVYNELTKVKFIA--EGMRDYqFLDSGQKKDIVKTLFK--TKR-KVTA 561
WP_049533112  487 SAEKFITRMTLNDLYLPEEKVLPKHSLLYETFTVYNELTKVKYVN--EQGEAK-FFDANMKQEIFDHVFK--ENR-KVTK 560
WP_029090905  472 SSEAFIKRMTNKCTYLIHEDVIPKHSFSYAKFEVLNELNKIRLDG------KP--IDIPLKKRIFEGLFL---EKtKVTQ 540
WP_006506696  499 TAEGFIKRMRSYCTYFPDEEVLPKNSLIVSKYEVYNELNKIRVDD--------kLLEVDVKNDIYNELFM--KNK-TVTE 567
AIT42264      487 SAQSFIERMTNFDKNLPNEKVLPKHSLLYEYFTVYNELTKVKYVT--EGMRKPaFLSGEQKKAIVDLLFK--TNR-KVTV 561
WP_034440723  494 SAELFIENLTSRDTYLPDEPVLPKRSLIYQKFTIFNELTKISYID--ERGILQ-NESSREKIAIFNDLFK---NKsKVTK 567
AKQ21048      487 SAQSFIERMTNFDKNLPNEKVLPKHSLLYEYFTVYNELTKVKYVT--EGMRKPaFLSGEQKKAIVDLLFK--TNR-KVTV 561
WP_004636532  489 SAEKFIERMTNMDTYLLEEKVLPKRSLLYQTFEVYNELTKVRYTN--EQGKTE-KLNRQQKAEIIETLFK-qKNR--VRE 562
WP_002364836  496 SATAFIERMTNFDTYLPSEKVLPKHSLLYEKFMVFNELTKISYTD--DRGIKA-NFSGKEKEKIFDYLFK--TRR-KVKK 569
WP_016631044  447 SATAFIERMTNFDTYLPSEKVLPKHSLLYEKFMVFNELTKISYTD--DRGIKA-NFSGKEKEKIFDYLFK--TRR-KVKK 520
EMS75795      232 SAMKFIQRMINYDTYLPTEKVLPKHSILYQKYTIFNELTKVAYKD--ERGIKH-QFSSKEKREIFKELFQ--KQR-KVTV 305
WP_002373311  496 SATAFIERMTNFDTYLPSEKVLPKHSLLYEKFMVFNELTKISYTD--DRGIKA-NFSGKEKEKIFDYLFK--TRR-KVKK 569
WP_002378009  496 SATAFIERMTNFDTYLPSEKVLPKHSLLYEKFMVFNELTKISYTD--DRGIKA-NFSGKEKEKIFDYLFK--TRR-KVKK 569
WP_002407324  496 SATAFIERMTNFDTYLPSEKVLPKHSLLYEKFMVFNELTKISYTD--DRGIKA-NFSGKEKEKIFDYLFK--TRR-KVKK 569
WP_002413717  496 SATAFIERMTNFDTYLPSEKVLPKHSLLYEKFMVFNELTKISYTD--DRGIKA-NFSGKEKEKIFDYLFK--TRR-KVKK 569
WP_010775580  498 SATAFIERMTNFDTYLPSEKVLPKHSLLYEKFMVFNELTKISYTD--DRGIKA-NFSGKEKEKIFDYLFK--TRR-KVKK 571
WP_010818269  496 SATAFIERMTNFDTYLPSEKVLPKHSLLYEKFMVFNELTKISYTD--DRGIKA-NFSGKEKEKIFDYLFK--TRR-KVKK 569
WP_010824395  496 SATAFIERMTNFDTYLPSEKVLPKHSLLYEKFMVFNELTKISYTD--DRGIKA-NFSGKEKEKIFDYLFK--TRR-KVKK 569
WP_016622645  496 SATAFIERMTNFDTYLPSEKVLPKHSLLYEKFMVFNELTKISYTD--DRGIKA-NFSGKEKEKIFDYLFK--TRR-KVKK 569
WP_033624816  496 SATAFIERMTNFDTYLPSEKVLPKHSLLYEKFMVFNELTKISYTD--DRGIKA-NFSGKEKEKIFDYLFK--TRR-KVKK 569
WP_033625576  496 SATAFIERMTNFDTYLPSEKVLPKHSLLYEKFMVFNELTKISYTD--DRGIKA-NFSGKEKEKIFDYLFK--TRR-KVKK 569
```

```
-continued
WP_033789179  496 SATAFIERMTNFDTYLPSEKVLPKHSLLYEKFMVFNELTKISYTD--DRGIKA-NFSGKEKEKIFDYLFK--TRR-KVKK 569

WP_002310644  493 SAVRFIERMINTDMYMPHNKVLPKNSLLYQKFSIYNELTKVRYQD--ERGQMN-YFSSIEKKEIFHELFE--KNR-KVTK 566

WP_002312694  494 SAVRFIERMINTDMYMPHNKVLPKNSLLYQKFSIYNELTKVRYQD--ERGQMN-YFSSIEKKEIFHELFE--KNR-KVTK 567

WP_002314015  494 SAVRFIERMNNTDMYIPHNKVLPKNSLLYQKFSIYNELTKVRYQD--ERGQMN-YFSSIEKKEIFHELFE--KNR-KVTK 567

WP_002320716  494 SAVRFIERMINTDMYIPHNKVLPKNSLLYQKFSIYNELTKVRYQD--ERGQMN-YFSSIEKKEIFHELFE--KNR-KVTK 567

WP_002330729  493 SAVRFIERMINTDMYIPHNKVLPKNSLLYQKFSIYNELTKVRYQD--ERGQMN-YFSSIEKKEIFHELFE--KNR-KVTK 566

WP_002335161  494 SAVRFIERMINTDMYMPHNKVLPKNSLLYQKFSIYNELTKVRYQD--ERGQMN-YFSSIEKKEIFHELFE--KNR-KVTK 567

WP_002345439  494 SAVRFIERMINTDMYIPHNKVLPKNSLLYQKFSIYNELTKVRYQD--ERGQMN-YFSSIEKKEIFHELFE--KNR-KVTK 567

WP_034867970  487 SAMRFIQRMTKQDTYLPTEKVLPKNSLLYQKYMIFNELTKVSYKD--ERGVKQ-YFSGDEKQQIFKQLFQ--KERgKITV 561

WP_047937432  494 SAVRFIERMINTDMYMPHNKVLPKNSLLYQKFSIYNELTKVRYQD--ERGQMN-YFSSIEKKEIFHELFE--KNR-KVTK 567

WP_010720994  487 SAMRFIQRMTKQDTYLPTEKVLPKNSLFYQKYMIFNELTKVSYKD--ERGVKQ-YFSGDEKQQIFKQLFQ--KERgKITV 561

WP_010737004  487 SAMRFIQRMTKQDTYLPTEKVLPKNSLLYQKYMIFNELTKVSYKD--ERGVKQ-YFSGDEKQQIFKQLFQ--KERgKITV 561

WP_034700478  487 SAMRFIQRMTKQDTYLPTEKVLPKNSLLYQKYMIFNELTKVSYKD--ERGVKQ-YFSGDEKQQIFKQLFQ--KERgKITV 561

WP_007209003  491 SAVAFIERMTIKDIYL-NENVLPRHSLIYEKFTVFNELTKVLYAD--DRGVFQ-RFSAEEKEDIFEKLFK--SER-KVTK 563

WP_023519017  486 SAIEFIERMTNQDTYLPKEKVLPKQSLIYQRFMIFNELTKVSYTD--ERGKSH-YFSSEQKRKIFNELFK--QHP-RVTE 559

WP_010770040  490 SATKFIERMTNFDTYLPTEKVLPKHSMIYEKYMVYNELTKVSYVD--ERGMNQ-RFSGEEKKQIVEELFK--QSR-KVTK 563

WP_048604708  486 SAELFIERMTNFDLYLPSEKVLPKHSMLYEKYTVYNELTKVTYKD--EQGKVQ-NFSSEEKERIFIDLFK--QHR-KVTK 559

WP_010750235  487 SATKFIQRMINYDTYLPTEKVLPKYSMLYQKYTIFNELTKVAYKD--DRGIKH-QFSSEEKLRIFQELFK--KQR-RVTK 560

AII16583      526 SAQSFIERMTNFDKNLPNEKVLPKHSLLYEYFTVYNELTKVKYVT--EGMRKPaFLSGEQKKAIVDLLFK--TNR-KVTV 600

WP_029073316  507 TADEFIKRMRNFCTYFPDEPVLAKNSLTVSKYEVLNEINKLRIND--------hLIKRDIKDKMLHTLFM--DHK-SISA 575

WP_031589969  507 TADEFIKRMRNFCTYFPDEPVMAKNSLTVSKYEVLNEINKLRIND--------hLIKRDMKDKMLHTLFM--DHK-SISA 575

KDA45870      485 SAEDFIKRMTINDLYLPTEPVLPKHSLLYERYTIFNELAGVRYVT--ENGEAK-YFDAQTKRSIFE-LFKl--DR-KVSE 557

WP_039099354  510 SANEFIKRMTTTDTYLLAEDVLPKQSLIYQRFEVLNELNGLKIDD--QPITTE-----LKQAIFTDLFM----QKtSVTV 578

AKP02966      484 SSNKFIRRMTVTDSYLVGEPVLPKNSLIYQRYEVLNELNNIRITEnlKTNPTGSRLTVETKQHIYNELFK--NYK-KITV 560

WP_010991369  493 SAVDFIEKMTNKDTYLPKENVLPKHSLCYQKYLVYNELTKVRYIN--DQGKTS-YFSGQEKEQIFNDLFK--QKR-KVKK 566

WP_033838504  493 SAVDFIEKMTNKDTYLPKENVLPKHSLCYQKYLVYNELTKVRYIN--DQGKTS-YFSGQEKEQIFNDLFK--QKR-KVKK 566

EHN60060      496 SAVDFIEKMTNKDTYLPKENVLPKHSLCYQKYLVYNELTKVRYIN--DQGKTS-YFSGQEKEQIFNDLFK--QKR-KVKK 569

EFR89594      262 SAVDFIEKMTNKDTYLPKENVLPKHSLCYQKYLVYNELTKVRYIN--DQGKTS-YFSGQEKEQIFNDLFK--QKR-KVKK 335

WP_038409211  493 SAIDFIEKMTNKDTYLPKENVLPKHSLCYQKYMVYNELTKIRYID--DQGKTH-HFSGQEKQQIFNGLFK--QQR-KVKK 566

EFR95520      112 SAIDFIEKMTNKDTYLPKENVLPKHSLCYQKYMVYNELTKIRYID--DQGKTH-HFSGQEKQQIFNGLFK--QQR-KVKK 185

WP_003723650  493 SAVDFIEKMTNKDTYLPKENVLPKHSLCYQKYMVYNELTKIRYID--DQGKTN-YFSGREKQQVENDLFK--QKR-KVKK 566

WP_003727705  493 SAVDFIEKMTNKDTYLPKENVLPKHSLCYQKYMVYNELTKIRYID--DQGKTN-YFSGREKQQIFNDLFK--QKR-KVKK 566

WP_003730785  493 SAVDFIEKMTNKDTYLPKENVLPKHSLCYQKYMVYNELTKIRYID--DQGKTN-YFSGREKQQIFNDLFK--QKR-KVKK 566

WP_003733029  493 SAVDFIEKMTNKDTYLPKENVLPKHSLCYQKYMVYNELTKVRYID--DQGKTN-YFSGQEKQQIFNDLFK--QKR-KVKK 566

WP_003739838  493 SAVDFIEKMTNKDTYLPKENVLPKHSLYYQKYMVYNELTKVRYID--DQGKIN-YFSGQEKQQIFNDYFK--QKR-KVSK 566

WP_014601172  493 SAVDFIEKMTNKDTYLPKENVLPKHSLCYQKYMVYNELTKVRYID--DQGKTN-YFSGQEKQQIFNDLFK--QKR-KVKK 566

WP_023548323  493 SAVDFIEKMTNKDTYLPKENVLPKHSLCYQKYMVYNELTKIRYID--DQGKTN-YFSGQEKQQIFNDLFK--QKR-KVKK 566

WP_031665337  493 SAVDFIEKMTNKDTYLPKENVLPKHSLCYQKYMVYNELTKVRYID--DQGKTN-YFSGQEKQQIFNDLFK--QKR-KVKK 566

WP_031669209  493 SAVDFIEKMTNKDTYLPKENVLPKHSLCYQKYMVYNELTKVRYID--DQGKTN-YFSGQEKQQIFNDLFK--QKR-KVKK 566

WP_033920898  493 SAVDFIEKMTNKDTYLPKENVLPKHSLCYQKYMVYNELTKVRYID--DQGKTN-YFSGQEKQQIFNDLFK--QKR-KVKK 566

AKI42028      496 SAVDFIEKMTNKDTYLPKENVLPKHSLCYQKYMVYNELTKVRYID--DQGKTN-YFSGQEKQQIFNDLFK--QKR-KVKK 569
```

-continued

```
AKI50529         496 SAVDFIEKMTNKDTYLPKENVLPKHSLCYQKYMVYNELTKIRYID--DQGKTN-YFSGQEKQQIFNDLFK--QKR-KVKK 569
EFR83390           1 ---------------------------------------------------------------IFNDLFK--QKR-KVKK  14
WP_046323366     493 SAIDFIEKMTNKDTYLPKENVLPKHSMCYQKYMVYNELTKIRYTD--DQGKTH-YFSGQEKQQIFNDLFK--QKR-KVKK 566
AKE81011         503 SAQSFIERMTNFDKNLPNEKVLPKHSLLYEYFTVYNELTKVKYVT--EGMRKPaFLSGEQKKAIVDLLFK--TNR-KVTV 577
CUO82355         503 TAEGFIKRMRSYCTYFPDEEVLPKNSLIVSKYEVYNELNKIRVDD--------kLLEVDVKNDIYNELFM--KNK-TVTE 571
WP_033162887     504 TAEGFIERMKNTGTYFPDEPVMAKNSLTVSKFEVLNELNKIRING--------kLIAVETKKELLSDLFM--KNK-TITD 572
AGZ01981         520 SAQSFIERMTNFDKNLPNEKVLPKHSLLYEYFTVYNELTKVKYVT--EGMRKPaFLSGEQKKAIVDLLFK--TNR-KVTV 594
AKA60242         487 SAQSFIERMTNFDKNLPNEKVLPKHSLLYEYFTVYNELTKVKYVT--EGMRKPaFLSGEQKKAIVDLLFK--TNR-KVTV 561
AKS40380         487 SAQSFIERMTNFDKNLPNEKVLPKHSLLYEYFTVYNELTKVKYVT--EGMRKPaFLSGEQKKAIVDLLFK--TNR-KVTV 561
4UN5_B           491 SAQSFIERMTNFDKNLPNEKVLPKHSLLYEYFTVYNELTKVKYVT--EGMRKPaFLSGEQKKAIVDLLFK--TNR-KVTV 565
WP_010922251     562 KQLKEDYFKK--IECFDSVEISGVEDR---FNASLGTYHDLLKIIKDK DELDNEENEDILEDIVLTLTLFEDREMIE     633
WP_039695303     564 EKLLNYLNKE--FPEYRIKDLIGLDKEnkSFNASLGTYHDLKKIL-DK AFLDDKVNEEVIEDIIKTLTLFEDKDMIH     637
WP_045635197     562 KDIIHYLHN----VDGYDGIELKGIEKQ---FNASLSTYHDLLKIIKDK EFMDDAKNEAILENIVHTLTIFEDREMIK    632
5AXW_A           300 KQIAKEILVNe--EDIKGYRVTSTGKPe---FTNLKVYHDIKDITARK ------ENAELLDQIAKILTIYQSSEDIQ    368
WP_009880683     246 KQLKEDYFKK--IECFDSVEISGVEDR---FNASLGTYHDLLKIIKDK DFLDNEENEDILEDIVLTLTLFEDREMIE    317
WP_010922251     562 KQLKEDYFKK--IECFDSVEISGVEDR---FNASLGTYHDLLKIIKDK DELDNEENEDILEDIVLTLTLFEDREMIE    633
WP_011054416     562 KQLKEDYFKK--IECFDSVEISGVEDR---FNASLGTYHDLLKIIKDK DELDNEENEDILEDIVLTLTLFEDREMIE    633
WP_011284745     562 KQLKEDYFKK--IECFDSVEISGVEDR---FNASLGTYHDLLKIIKDK DFLDNEENEDILEDIVLTLTLFEDREMIE    633
WP_011285506     562 KQLKEDYFKK--IECFDSVEISGVEDR---FNASLGTYHDLLKIIKDK DFLDNEENEDILEDIVLTLTLFEDREMIE    633
WP_011527619     562 KQLKEDYFKK--IECFDSVEISGVEDR---FNASLGTYHDLLKIIKDK DFLDNEENEDILEDIVLTLTLFEDREMIE    633
WP_012560673     562 KQLKEDYFKK--IECFDSVEISGVEDR---FNASLGTYHDLLKIIKDK DFLDNEENEDILEDIVLTLTLFEDREMIE    633
WP_014407541     562 KQLKEDYFKK--IECFDSVEISGVEDR---FNASLGAYHDLLKIIKDK DFLDNEENEDILEDIVLTLTLFEDRGMIE    633
WP_020905136     562 KQLKEDYFKK--IECFDSVEISGVEDR---FNASLGTYHDLLKIIKDK DFLDNEENEDILEDIVLTLTLFEDREMIE    633
WP_023080005     562 KQLKEDYFKK--IECFDSVEISGVEDR---FNTSLGTYHDLLKIIKDK DFLDNEENEDILEDIVLTLTLFEDKEMIE    633
WP_023610282     562 KQLKEDYFKK--IECFDSVEISGVEDR---FNTSLGTYHDLLKIIKDK DELDNEENEDILEDIVLTLTLFEDKEMIE    633
WP_030125963     562 KQLKEDYFKK--IECFDSVEISGVEDR---FNASLGTYHDLLKIIKDK DFLDNEENEDILEDIVLTLTLFEDREMIE    633
WP_030126706     562 KQLKEDYFKK--IECFDSVEISGVEDR---FNASLGTYHDLLKIIKDK DFLDNEENEDILEDIVLTLTLFEDREMIE    633
WP_031488318     562 KQLKEDYFKK--IECFDSVEISGVEDR---FNASLGTYHDLLKIIKDK DELDNEENEDILEDIVLTLTLFEDREMIE    633
WP_032460140     562 KQLKEDYFKK--IECFDSVEISGVEDR---FNASLGTYHDLLKIIKDK DELDNEENEDILEDIVLTLTLFEDREMIE    633
WP_032461047     562 KQLKEDYFKK--IECFDSVEISGVEDR---FNASLGTYHDLLKIIKDK DELDNEENEDILEDIVLTLTLFEDREMIE    633
WP_032462016     562 KQLKEDYFKK--IECFDSVEISGVEDR---FNASLGTYHDLLKIIKDK DELDNEENEDILEDIVLTLTLFEDREMIE    633
WP_032462936     562 KQLKEDYFKK--IECFDSVEISGVEDR---FNASLGTYHDLLKIIKDK DFLDNEENEDILEDIVLTLTLFEDKEMIE    633
WP_032464890     562 KQLKEDYFKK--IECFDSVEISGVEDR---FNASLGTYHDLLKIIKDK DFLDNEENEDILEDIVLTLTLFEDREMIE    633
WP_033888930     387 KQLKEDYFKK--IECFDSVEISGVEDR---FNASLGTYHDLLKIIKDK DFLDNEENEDILEDIVLTLTLFEDREMIE    458
WP_038431314     562 KQLKEDYFKK--IECFDSVEISGVEDR---FNASLGTYHDLLKIIKDK DELDNEENEDILEDIVLTLTLFEDREMIE    633
WP_038432938     562 KQLKEDYFKK--IECFDSVEISGVEDR---FNTSLGTYHDLLKIIKDK DFLDNEENEDILEDIVLTLTLFEDKEMIE    633
WP_038434062     562 KQLKEDYFKK--IECFDSVEISGVEDR---FNASLGTYHDLLKIIKDK DELDNEENEDILEDIVLTLTLFEDREMIE    633
BAQ51233         473 KQLKEDYFKK--IECFDSVEISGVEDR---FNASLGTYHDLLKIIKDK DFLDNEENEDILEDIVLTLTLFEDREMIE    544
KGE60162             ------------------------------------------------ ----------------------------
KGE60856             ------------------------------------------------ ----------------------------
```

-continued

```
WP_002989955    562 KQLKEDYFKK--IECFDSVEISGVEDR---FNASLGTYHDLLKIIKDK DFLDNEENEDILEDIVLTLTLFEDREMIE   633

WP_003030002    561 DKLLNYLNKE--FEEFRIVNLTGLDKEnkAFNSSLGTYHDLRKIL-DK SFLDDKANEKTIEDIIQTLTLFEDREMIR   634

WP_003065552    564 EKLLNYLNKE--FPEYRIKDLIGLDKEnkSFNASLGTYHDLKKIL-DK AFLDDKVNEEVIEDIIKTLTLFEDKDMIH   637

WP_001040076    563 KDIISFLNK----VDGYEGIAIKGIEKQ---FNASLSTYHDLKKIL-GK DFLDNTDNELILEDIVQTLTLFEDREMIK   632

WP_001040078    562 KKLLDFLAKE--YEEFRIVDVIGLDKEnkAFNASLGTYHDLEKIL-DK DFLDNPDNESILEDIVQTLTLFEDREMIK   635

WP_001040080    562 KKLLDFLAKE--YEEFRIVDVIGLDKEnkAFNASLGTYHDLEKIL-DK DFLDNPDNESILEDIVQTLTLFEDREMIK   635

WP_001040081    562 KKLLDFLAKE--YEEFRIVDVIGLDKEnkAFNASLGTYHDLEKIL-DK DFLDNPDNESILEDIVQTLTLFEDREMIK   635

WP_001040083    562 KKLLDFLAKE--YEEFRIVDVIGLDKEnkAFNASLGTYHDLEKIL-DK DFLDNPDNESILEDIIQTLTLFEDREMIK   635

WP_001040085    562 KKLLDFLAKE--YEEFRIVDVIGLDKEnkAFNASLGTYHDLEKIL-DK DFLDNPDNESILEDIVQTLTLFEDREMIK   635

WP_001040087    562 KKLLDFLAKE--YEEFRIVDVIGLDKEnkAFNASLGTYHDLEKIL-DK DFLDNPDNESILEDIVQTLTLFEDREMIK   635

WP_001040088    562 KKLLDFLAKE--YEEFRIVDVIGLDKEnkAFNASLGTYHDLEKIL-DK DFLDNPDNESILEDIVQTLTLFEDREMIK   635

WP_001040089    562 KKLLDFLAKE--YEEFRIVDVIGLDKEnkAFNASLGTYHDLEKIL-DK DFLDNPDNESILEDIVQTLTLFEDREMIK   635

WP_001040090    562 KKLLDFLAKE--YEEFRIVDVIGLDKEnkAFNASLGTYHDLEKIL-DK DFLDNPDNESILEDIVQTLTLFEDREMIK   635

WP_001040091    562 KKLLDFLAKE--YEEFRIVDVIGLDKEnkAFNASLGTYHDLEKIL-DK DFLDNPDNESILEDIVQTLTLFEDREMIK   635

WP_001040092    562 KQLLDFLAKE--FEEFRIVDVTGLDKEnkAFNASLGTYHDLKKIL-DK DFLDNPDNESILEDIVQTITLFEDREMIK   635

WP_001040094    563 KDIISFLNK----VDGYEGIAIKGIEKQ---FNASLSTYHDLKKIL-GK DFLDNTDNELILEDIVQTLTLFEDREMIR   632

WP_001040095    563 KDIISFLNK----VDGYEGIAIKGIEKQ---FNASLSTYHDLKKIL-GK DFLDNTDNELILEDIVQTLTLFEDREMIR   632

WP_001040096    563 KDIISFLNK----VDGYEGIAIKGIEKQ---FNASLSTYHDLKKIL-GK DFLDNTDNELILEDIVQTLTLFEDREMIR   632

WP_001040097    563 KDIISFLNK----VDGYEGIAIKGIEKQ---FNASLSTYHDLKKIL-GK DFLDNTDNELILEDIVQTLTLFEDREMIR   632

WP_001040098    563 KDIISFLNK----VDGYEGIAIKGIEKQ---FNASLSTYHDLKKIL-GK DFLDNTDNELILEDIVQTLTLFEDREMIR   632

WP_001040099    563 KDIISFLNK----VDGYEGIAIKGIEKQ---FNASLSTYHDLKKIL-GK DFLDNTDNELILEDIVQTLTLFEDREMIR   632

WP_001040100    563 KDIISFLNK----VDGYEGIAIKGIEKQ---FNASLSTYHDLKKIL-GK DELDNTDNELILEDIVQTLTLFEDREMIR   632

WP_001040104    562 KKLLDFLAKE--YEEFRIVDVIGLDKEnkAFNASLGTYHDLEKIL-DK DFLDNPDNESILEDIVQTLTLFEDREMIK   635

WP_001040105    562 KKLLDFLAKE--YEEFRIVDVIGLDKEnkAFNASLGTYHDLEKIL-DK DFLDNPDNESILEDIVQTLTLFEDREMIK   635

WP_001040106    562 KKLLDFLAKE--YEEFRIVDVIGLDKEnkAFNASLGTYHDLKKIL-DK DFLDNPDNESILEDIVQTLTLFEDREMIK   635

WP_001040107    562 KKLLDFLAKE--YEEFRIVDVIGLDKEnkAFNASLGTYHDLKKIL-DK DFLDNPDNESILEDIVQTLTLFEDREMIK   635

WP_001040108    562 KKLLDFLAKE--YEEFRIVDVIGLDKEnkAFNASLGTYHDLKKIL-DK DFLDNPDNESILEDIVQTLTLFEDREMIK   635

WP_001040109    562 KKLLDFLAKE--YEEFRIVDVIGLDKEnkAFNASLGTYHDLKKIL-DK DFLDNPDNESILEDIVQTLTLFEDREMIK   635

WP_001040110    562 KKLLDFLAKE--YEEFRIVDVIGLDKEnkAFNASLGTYHDLKKIL-DK DFLDNPDNESILEDIVQTLTLFEDREMIK   635

WP_015058523    562 KQLLDFLAKE--FEEFRIVDVTGLDKEnkAFNASLGTYHDLKKIL-DK DFLDNPDNESILEDIVQTITLFEDREMIK   635

WP_017643650    563 KDIISFLNK----VDGYEGIAIKGIEKQ---FNASLSTYHDLKKIL-GK DFLDNTDNELILEDIVQTLTLFEDREMIR   632

WP_017647151    562 KKLLDFLAKE--YEEFRIVDVIGLDKEnkAFNASLGTYHDLKKIL-DK DFLDNPDNESILEDIVQTLTLFEDREMIK   635

WP_017648376    562 KKLLDFLAKE--YEEFRIVDVIGLDKEnkAFNASLGTYHDLKKIL-DK DFLDNPDNESILEDIVQTLTLFEDREMIK   635

WP_017649527    562 KKLLDFLAKE--YEEFRIVDVIGLDKEnkAFNASLGTYHDLKKIL-DK DELDNPDNESILEDIVQTLTLFEDREMIK   635

WP_017771611    562 KKLLDFLAKE--YEEFRIVDVIGLDKEnkAFNASLGTYHDLKKIL-DK DFLDNPDNESILEDIVQTLTLFEDREMIK   635

WP_017771984    562 KKLLDFLAKE--YEEFRIVDVIGLDKEnkAFNASLGTYHDLKKIL-DK DELDNPDNESILEDIVQTLTLFEDREMIK   635

CFQ25032        562 KKLLDFLAKE--YEEFRIVDVIGLDKEnkAFNASLGTYHDLEKIL-DK DFLDNPDNESILEDIVQTLTLFEDREMIK   635

CFV16040        562 KKLLDFLAKE--YEEFRIVDVIGLDKEnkAFNASLGTYHDLEKIL-DK DELDNPDNESILEDIVQTLTLFEDREMIK   635

KLJ37842        562 KKLLDFLAKE--YEEFRIVDVIGLDKEnkAFNASLGTYHDLEKIL-DK DFLDNPDNESILEDIVQTLTLFEDREMIK   635

KLJ72361        562 KKLLDFLAKE--YEEFRIVDVIGLDKEnkAFNASLGTYHDLEKIL-DK DFLDNPDNESILEDIVQTLTLFEDREMIK   635

KLL20707        562 KKLLDFLAKE--YEEFRIVDVIGLDKEnkAFNASLGTYHDLEKIL-DK DFLDNPDNESILEDIVQTLTLFEDREMIK   635
```

-continued

```
KLL42645        562 KKLLDFLAKE--YEEFRIVDVIGLDKEnkAFNASLGTYHDLKKIL-DK DELDNPDNESILEDIVQTLTLFEDREMIK 635

WP_047207273    562 KKLLDFLAKE--YEEFRIVDVIGLDKEnkAFNASLGTYHDLEKIL-DK DFLDNPDNESILEDIVQTLTLFEDREMIK 635

WP_047209694    563 KDIISFLNK---VDGYEGIAIKGIEKQ---FNASLSTYHDLKKIL-GK DFLDNTDNELILEDIVQTLTLFEDREMIR 632

WP_050198062    562 KKLLDFLAKE--YEEFRIVDVIGLDKEnkAFNASLGTYHDLEKIL-DK DFLDNPDNESILEDIVQTLTLFEDREMIK 635

WP_050201642    562 KKLLDFLAKE--YEEFRIVDVIGLDKEnkAFNASLGTYHDLEKIL-DK DELDNPDNESILEDIVQTLTLFEDREMIK 635

WP_050204027    562 KKLLDFLAKE--YEEFRIVDVIGLDKEnkAFNASLGTYHDLKKIL-DK DFLDNPDNESILEDIVQTLTLFEDREMIK 635

WP_050881965    562 KKLLDFLAKE--YEEFRIVDVIGLDKEnkAFNASLGTYHDLEKIL-DK DFLDNPDNESILEDIVQTLTLFEDREMIK 635

WP_050886065    562 KKLLDFLAKE--YEEFRIVDVIGLDKEnkAFNASLGTYHDLEKIL-DK DFLDNPDNESILEDIVQTLTLFEDREMIK 635

AHN30376        562 KQLLDFLAKE--FEEFRIVDVTGLDKEnkAFNASLGTYHDLKKIL-DK DELDNPDNESILEDIVQTITLFEDREMIK 635

EAO78426        562 KKLLDFLAKE--YEEFRIVDVIGLDKEnkAFNASLGTYHDLEKIL-DK DFLDNPDNESILEDIVQTLTLFEDREMIK 635

CCW42055        562 KQLLDFLAKE--FEEFRIVDVTGLDKEnkAFNASLGTYHDLEKIL-GK DFLDNPDNESILEDIVQTLTLFEDREMIK 635

WP_003041502    561 DKLLNYLNKE--FEEFRIVNLTGLDKEnkVENSSLGTYHDLRKIL-NK SFLDNKENAQIIEDIIQTLTLFEDREMIR 634

WP_037593752    562 DKLLNYLNKE--FEEFRIVNLTGLDKEnkAFNSSLGTYHDLRKIL-DK SFLDDKANEKTIEDIIQTLTLFEDREMIR 635

WP_049516684    562 DKLLNYLNKE--FEEFRIVNLTGLDKEnkAFNSSLGTYHDLRKIL-DK SFLDDKVNEKIIEDIIQTLTLFEDREMIR 635

GAD46167        561 DKLLNYLNKE--FEEFRIVNLTGLDKEnkAFNSSLGTYHDLRKIL-DK SFLDDKANEKTIEDIIQTLTLFEDREMIR 634

WP_018363470    562 EKLLNYLDKE--FPEYRIQDLVGLDKEnkSFNASLGTYHDLKKIL-DK SFLDDKVNEEVIEDIIKTLTLFEDREMIQ 635

WP_003043819    572 KQLKEDYFKK--IECFDSVEIIGVEDR---FNASLGTYHDLLKIIKDK DFLDNEENEDILEDIVLTLTLFEDREMIE 643

WP_006269658    561 DKLLNYLNKE--FEEFRIVNLTGLDKEnkAFNSSLGTYHDLRKIL-DK SFLDDKANEKTIEDIIQTLTLFEDREMIR 634

WP_048800889    561 DKLLNYLDKE--FDEFRIVDLTGLDKEnkAFNASLGTYHDLRKIL-DK SFLDDKANEKTIEDIIQTLTLFEDREMIR 634

WP_012767106    562 KQLKEDYFKK--IECFDSVEISGVEDR---FNASLGTYHDLLKIIKDK DFLDNEENEDILEDIVLTLTLFEDKEMIE 633

WP_014612333    562 KQLKEDYFKK--IECFDSVEISGVEDR---FNASLGTYHDLLKIIKDK DELDNEENEDILEDIVLTLTLFEDKEMIE 633

WP_015017095    562 KQLKEDYFKK--IECFDSVEISGVEDR---FNASLGTYHDLLKIIKDK DFLDNEENEDILEDIVLTLTLFEDKEMIE 633

WP_015057649    562 KQLKEDYFKK--IECFDSVEISGVEDR---FNASLGTYHDLLKIIKDK DFLDNEENEDILEDIVLTLTLFEDKEMIE 633

WP_048327215    562 KQLKEDYFKK--IECFDSVEISGVEDR---FNASLGTYHDLLKIIKDK DFLDNEENEDILEDIVLTLTLFEDKEMIE 633

WP_049519324    562 KQLKEDYFKK--IECFDSVEISGVEDR---FNASLGTYHDLLKIIKDK DFLDNEENEDILEDIVLTLTLFEDKEMIE 633

WP_012515931    562 KQLKENYFKK--IECWDSVEITGVEDS---FNASLGTYHDLLKIIQDK DFLDNPDNQKIIEDIILTLTLFEDKKMIS 633

WP_021320964    562 KQLKENYFKK--IECWDSVEITGVEDS---FNASLGTYHDLLKIIQDK DFLDNPDNQKIIEDIILTLTLFEDKKMIS 633

WP_037581760    562 KQLKENYFKK--IECWDSVEITGVEDS---FNASLGTYHDLLKIIQDK DFLDNPDNQKIIEDIILTLTLFEDKKMIS 633

WP_004232481    561 AKLLSYLNNE--FEEFRINDLIGLDKDskSFNASLGTYHDLKKIL-DK SFLDDKTNEQIIEDIVLTLTLFEDRDMIH 634

WP_009854540    562 EKLLNYLNKE--FPEYRIKDLIGLDKEnkSFNASLGTYHDLKKIL-DK AFLDDKVNEEVIEDIIKTLTLFEDKDMIH 635

WP_012962174    562 DKFLNYLNKE--FPEYRIQDLIGLDKEnkSFNASLGTYHDLKKIL-DK SFLDDKTNETIIEDIIQTLTLFEDRDMIR 635

WP_039695303    564 EKLLNYLNKE--FPEYRIKDLIGLDKEnkSFNASLGTYHDLKKIL-DK AFLDDKVNEEVIEDIIKTLTLFEDKDMIH 637

WP_014334983    561 AKLLSYLNNE--FEEFRINDLIGLDKDSKSFNASLGTYHDLKKIL-DK SFLDDKINGQIIEDIVLTLTLFEDRDMIH 634

WP_003099269    562 KQLKEEYFSK--MKCFHTVTILGVEDR---FNASLGTYHDLLKIFKDK AFLDDEANQDILEEIVWTLTLFEDQAMIE 633

AHY15608        562 KQLKEEYFSK--MKCFHTVTILGVEDR---FNASLGTYHDLLKIFKDK AFLDDEANQDILEEIVWTLTLFEDQAMIE 633

AHY17476        562 KQLKEEYFSK--MKCFHTVTILGVEDR---FNASLGTYHDLLKIFKDK AFLDDEANQDILEEIVWTLTLFEDQAMIE 633

ESR09100            ------------------------------------------------ ----------------------------

AGM98575        562 KQLKEEYFSK--MKCFHTVTILGVEDR---FNASLGTYHDLLKIFKDK AFLDDEANQDILEEIVWTLTLFEDQAMIE 633

ALF27331        561 DKLMDFLEKE--FDEFRIVDLTGLDKEnkAFNASYGTYHDLRKIL-DK DFLDNSKNEKILEDIVLTLTLFEDREMIR 634

WP_018372492    574 RKLKDFIEKElgYGYIDIDNIKGVEEQ---FNASYTTYQDLLKIIGDK EFLDNEENKDLLEEIIYILTVFEDRKMIE 647
```

-continued

```
WP_045618028  563 KDIIQYLHN---VDSYDGIELKGIEKQ---FNASLSTYHDLLKIIKDK EFMDDSKNEAILENIVHTLTIFEDREMIK  633
WP_045635197  562 KDIIHYLHN---VDGYDGIELKGIEKQ---FNASLSTYHDLLKIIKDK EFMDDAKNEAILENIVHTLTIFEDREMIK  632
WP_002263549  561 DKLMDFLEKE---FDEFRIVDLTGLDKEnkVFNASYGTYHDLCKIL-DK DFLDNSKNEKILEDIVLTLTLFEDREMIR  634
WP_002263887  561 DKLMDFLEKE---FDEFRIVDLTGLDKEnkVFNASYGTYHDLCKIL-DK DFLDNSKNEKILEDIVLTLTLFEDREMIR  634
WP_002264920  561 DKLMDFLEKE---FDEFRIVDLTGLDKEnkAFNASYGTYHDLRKIL-DK DFLDNSKNEKILEDIVLTLTLFEDREMIR  634
WP_002269043  561 DKLMDFLEKE---FDEFRIVDLTGLDKEnkAFNASYGTYHDLRKIL-DK DFLDNSKNEKILEDIVLTLTLFEDREMIR  634
WP_002269448  561 DKLMDFLEKE---FDEFRIVDLTGLDKEnkVFNASYGTYHDLCKIL-DK DELDNSKNEKILEDIVLTLTLFEDREMIR  634
WP_002271977  561 DKLMDFLEKE---FDEFRIVDLTGLDKEnkVFNASYGTYHDLCKIL-DK DFLDNSKNEKILEDIVLTLTLFEDREMIR  634
WP_002272766  561 DKLMDFLEKE---FDEFRIVDLTGLDKEnkVFNASYGTYHDLCKIL-DK DFLDNSKNEKILEDIVLTLTLFEDREMIR  634
WP_002273241  561 DKLMDFLEKE---FDEFRIVDLTGLDKEnkVFNASYGTYHDLCKIL-DK DFLDNSKNEKILEDIVLTLTLFEDREMIR  634
WP_002275430  561 DKLMDFLEKE---FDEFRIVDLTGLDKEnkAFNASYGTYHDLRKIL-DK DELDNSKNEKILEDIVLTLTLFEDREMIR  634
WP_002276448  561 DKLMDFLEKE---FDEFRIVDLTGLDKEnkVFNASYGTYHDLCKIL-DK DFLDNSKNEKILEDIVLTLTLFEDREMIR  634
WP_002277050  561 KKLRTFLDKN---FDEFRIVDIQGLDKEteTFNASYATYQDLLKVIKDK VFMDNPENAEILENIVLTLTLFEDREMIK  635
WP_002277364  561 DKLMDFLEKE---FDEFRIVDLTGLDKEnkAFNASYGTYHDLRKIL-DK DELDNSKNEKILEDIVLTLTLFEDREMIR  634
WP_002279025  561 DKLMDFLEKE---FDEFRIVDLTGLDKEnkAFNASYGTYHDLRKIL-DK DFLDNSKNEKILEDIVLTLTLFEDREMIR  634
WP_002279859  561 DKLMDFLEKE---FDEFRIVDLTGLDKEnkAFNASYGTYHDLRKIL-DK DFLDNSKNEKILEDIVLTLTLFEDREMIR  634
WP_002280230  561 DKLMDFLEKE---FDEFRIVDLTGLDKEnkVFNASYGTYHDLCKIL-DK DFLDNSKNEKILEDIVLTLTLFEDREMIR  634
WP_002281696  561 DKLMDFLEKE---FDEFRIVDLTGLDKEnkAFNASYGTYHDLRKIL-DK DFLDNSKNEKILEDIVLTLTLFEDREMIR  634
WP_002282247  561 KKLRTFLDKN---FDEFRIVDIQGLDKEteTFNASYATYQDLLKVIKDK VEMDNPENAEILENIVLTLTLFEDREMIK  635
WP_002282906  561 DKLMDFLEKE---FDEFRIVDLTGLDKEnkVFNASYGTYHDLCKIL-DK DFLDNSKNEKILEDIVLTLTLFEDREMIR  634
WP_002283846  561 DKLMDFLEKE---FDEFRIVDLTGLDKEnkAFNASYGTYHDLRKIL-DK DFLDNSKNEKILEDIVLTLTLFEDREMIR  634
WP_002287255  561 DKLMDFLEKE---FDEFRIVDLTGLDKEnkAFNASYGTYHDLRKIL-DK DFLDNSKNEKILEDIVLTLTLFEDREMIR  634
WP_002288990  561 DKLMDFLEKE---FDEFRIVDLTGLDKEnkAFNASYGTYHDLRKIL-DK DFLDNSKNEKILEDIVLTLTLFEDREMIR  634
WP_002289641  561 DKLMDFLEKE---FDEFRIVDLTGLDKEnkVFNASYGTYHDLCKIL-DK DELDNSKNEKILEDIVLTLTLFEDREMIR  634
WP_002290427  561 DKLMDFLEKE---FDEFRIVDLTGLDKEnkAFNASYGTYHDLRKIL-DK DELDNSKNEKILEDIVLTLTLFEDREMIR  634
WP_002295753  561 DKLMDFLEKE---FDEFRIVDLTGLDKEnkVFNASYGTYHDLCKIL-DK DELDNSKNEKILEDIVLTLTLFEDREMIR  634
WP_002296423  561 DKLMDFLEKE---FDEFRIVDLTGLDKEnkAFNASYGTYHDLRKIL-DK DFLDNSKNEKILEDIVLTLTLFEDREMIR  634
WP_002304487  571 DKLLNYLNKE---FEEFRIVNLTGLDKEnkVFNSSLGTYHDLRKIL-NK SFLDNKENEQIIEDIIQTLTLFEDREMIR  644
WP_002305844  561 DKLMDFLEKE---FDEFRIVDLTGLDKEnkVFNASYGTYHDLCKIL-DK DELDNSKNEKILEDIVLTLTLFEDREMIR  634
WP_002307203  561 DKLMDFLEKE---FDEFRIVDLTGLDKEnkAFNASYGTYHDLRKIL-DK DFLDNSKNEKILEDIVLTLTLFEDREMIR  634
WP_002310390  561 DKLMDFLEKE---FDEFRIVDLTGLDKEnkAFNASYGTYHDLRKIL-DK DFLDNSKNEKILEDIVLTLTLFEDREMIR  634
WP_002352408  561 DKLMDFLEKE---FDEFRIVDLTGLDKEnkAFNASYGTYHDLRKIL-DK DFLDNSKNEKILEDIVLTLTLFEDREMIR  634
WP_012997688  561 DKLMDFLEKE---FDEFRIVDLTGLDKEnkAFNASYGTYHDLRKIL-DK DFLDNSKNEKILEDIVLTLTLFEDREMIR  634
WP_014677909  561 DKLMDFLEKE---FDEFRIVDLTGLDKEnkAFNASYGTYHDLRKIL-DK DFLDNSKNEKILEDIVLTLTLFEDREMIR  634
WP_019312892  561 DKLMDFLEKE---FDEFRIVDLTGLDKEnkAFNASYGTYHDLRKIL-DK DFLDNSKNEKILEDIVLTLTLFEDREMIR  634
WP_019313659  561 DKLMDFLEKE---FDEFRIVDLTGLDKEnkVFNASYGTYHDLCKIL-DK DFLDNSKNEKILEDIVLTLTLFEDREMIR  634
WP_019314093  561 DKLMDFLEKE---FDEFRIVDLTGLDKEnkAFNASYGTYHDLRKIL-DK DFLDNSKNEKILEDIVLTLTLFEDREMIR  634
WP_019315370  561 DKLMDFLEKE---FDEFRIVDLTGLDKEnkAFNASYGTYHDLRKIL-DK DFLDNSKNEKILEDIVLTLTLFEDREMIR  634
WP_019803776  561 DKLMDFLEKE---FDEFRIVDLTGLDKEnkVFNASYGTYHDLCKIL-DK DFLDNSKNEKILEDIVLTLTLFEDREMIR  634
WP_019805234  561 DKLMDFLEKE---FDEFRIVDLTGLDKEnkAFNASYGTYHDLRKIL-DK DFLDNSKNEKILEDIVLTLTLFEDREMIR  634
WP_024783594  561 DKLMDFLEKE---FDEFRIVDLTGLDKEnkVFNASYGTYHDLCKIL-DK DFLDNSKNEKILEDIVLTLTLFEDREMIR  634
```

-continued

```
WP_024784288    561  KKLRTFLDKN--FDEFRIVDIQGLDKEteTFNASYATYQDLLKVIKDK VFMDNPENAEILENIVLTLTLFEDREMIK    635
WP_024784666    561  DKLMDFLEKE---FDEFRIVDLTGLDKEnkAFNASYGTYHDLRKIL-DK DFLDNSKNEKILEDIVLTLTLFEDREMIR    634
WP_024784894    561  DKLMDFLEKE---FDEFRIVDLTGLDKEnkVFNASYGTYHDLCKIL-DK DFLDNSKNEKILEDIVLTLTLFEDREMIR    634
WP_024786433    561  KKLRTFLDKN--FDEFRIVDIQGLDKEteTFNASYATYQDLLKVIKDK VFMDNPENAEILENIVLTLTLFEDREMIK    635
WP_049473442    561  DKLMDFLEKE---FDEFRIVDLTGLDKEnkVFNASYGTYHDLCKIL-DK DFLDNSKNEKILEDIVLTLTLFEDREMIR    634
WP_049474547    561  DKLMDFLEKE---FDEFRIVDLTGLDKEnkVFNASYGTYHDLCKIL-DK DFLDNSKNEKILEDIVLTLTLFEDREMIR    634
EMC03581        554  DKLMDFLEKE---FDEFRIVDLTGLDKEnkAFNASYGTYHDLRKIL-DK DFLDNSKNEKILEDIVLTLTLFEDREMIR    627
WP_000428612    565  KDIIQYLHT----VDGYDGIELKGIEKQ---FNASLSTYHDLLKIIKDK EFMDDPNNEEILENIVHTLTIFEDREMIK    635
WP_000428613    563  KDIIQFLHN----VDGYDGIELKGIEKQ---FNASLSTYHDLLKIIKDK EFMDDSKNEEILENIVHTLTIFEDREMIK    633
WP_049523028    562  KDIIHYLHN----VDGYDGIELKGIEKH---FNSSLSTYHDLLKIIKDK EFMDDPKNEEIFENIVHTLTIFEDRVMIK    632
WP_003107102    531  KQLKENYFNK--IRCLDSITISGVEDK---FNASLGTYHDLLNIIKNQ KILDDEQNQDSLEDIVLILTLFEDEKMIA    602
WP_054279288    564  KQLKEDFFSK--IECFDTVDISGVEDK---FNASLGTYHDLLKIIKDK AFLDNSENENIIEDIILTLTLFEDKEMIA    635
WP_049531101    563  KDLIHYLHN----VDGYDGIELKGIEKQ---FNASLSTYHDLLKIIKDK RFMDEPKNQEILENIVHTLTIFEDREMIK    633
WP_049538452    563  KDIIQYLHN----VDGYDGIELKGIEKQ---FNASLSTYHDLLKIIKDK EFMDDSKNEEILENIVHTLTIFEDREMIK    633
WP_049549711    563  KDIIHYLHT----VDGYDGIELKGIEKQ---FNASLSTYHDLLKIIKDK EFMDDSKNEAILENIVHTLTIFEDREMIK    633
WP_007896501    565  KDLKEKYFSQ--IEGLENVDVTGVEGA---FNASLGTYNDLLKIIKDK AFLDDEANAEILEEIVLILTLFQDEKLIE    636
EFR44625        517  KDLKEKYFSQ--IEGLENVDVTGVEGA---FNASLGTYNDLLKIIKDK AFLDDEANAEILEEIVLILTLFQDEKLIE    588
WP_002897477    562  KDIIHYLHN----VDGYDGIELKGIEKQ---FNANLSTYHDLLKITKDK EFMDDPKNEEILENIVHTLTIFEDREMIK    632
WP_002906454    562  KDIIHYLHN----VDGYDGIELKGIEKQ---FNASLSTYHDLLKIIKDK EFMDNPKNGEILENIIHTLTIFEDREMIK    632
WP_009729476    563  KDIIQFLHN----VDGYDGIELKGIEKQ---FNASLSTYHDLLKIIKDK AFMDDAKNEAILENIVHTLTIFEDREMIK    633
COR24647        562  KKILNFLDKN--FDEFRITDIQGLDNEtgNFNASYGTYHDLLKIIGDK EFMDSSDNVDVLEDIVLSLTLFEDREMIK    636
WP_000066813    565  KDIIHYLHN----VDGYDGIELKGIEKQ---FNASLSTYHDLLKIIKDK AFMDDSKNEEILENIIHTLTIFEDREMIK    635
WP_009754323    563  KDIIHYLHN----VDGYDGIELKGIEKQ---FNASLSTYHDLLKIIKDK EFMDNHKNQEILENIVHTLTIFEDREMIK    633
WP_044674937    562  KDIKAYL-EN--SNGYAGVELKGLEEQ---FNASLPTYHDLLKILRDK AFIDAEENQEILEDIVLTLTLFEDREMIR    632
WP_044676715    561  EKLMDFLGKE--FDEFRIVDLLGLDKDnkSFNASLGTYHDLKKIV-SK DLLDNPENEDILENVVLTLTLFEDREMIR    634
WP_044680361    561  EKLMDFLGKE--FDEFRIVDLLGLDKDnkSFNASLGTYHDLKKIV-SK DLLDNPENEDILENVVLTLTLFEDREMIR    634
WP_044681799    562  KDIKAYL-EN--SNGYAGVELKGLEEQ---FNASLPTYHDLLKILRDK AFIDAEENQEILEDIVLTLTLFEDREMIR    632
WP_049533112    561  DKLLNYLGKE--FDEFRIVDLTGLDKEnkVFNSSLGTYHDLRKIL-DK SFLDNKENEQIIEDIIQTLTLFEDREMIR    634
WP_029090905    541  TSLKKWLAEH---EHMTVSVVQGTQKEt-EFATSLQAFHRFVKIF-DR ETVSNPANEEMFEKIIYWSTVFEDKKIMR    612
WP_006506696    568  KKLKNWLVNNqcCS--KDAEIKGFQKEn-QFSTSLTPWIDFTNIFGKI ----DQSNEDLIENIIYDLTVFEDKKIMK    637
AIT42264        562  KQLKEDYFKK--IECFDSVEISGVEDR---FNASLGTYHDLLKIIKDK DFLDNEENEDILEDIVLTLTLFEDREMIE    633
WP_034440723    568  NQLVKYIENK----EQIIAPEIKGIEDS---FNSNYSTYIDLSKIPDMK --LLEKDEDEILEEIIKILTIFEDRKMRK    637
AKQ21048        562  KQLKEDYFKK--IECFDSVEISGVEDR---FNASLGTYHDLLKIIKDK DFLDNEENEDILEDIVLTLTLFEDREMIE    633
WP_004636532    563  KDIANYLEQ----YGYVDGTDIKGVEDK---FNASLSTYNDLAKIDGAK AYLDDPEYADVWEDIIKILTIFEDKAMRK    633
WP_002364836    570  KDIIQFYRNE--YN-TEIVTLSGLEED--QFNASFSTYQDLLKCGLTR AELDHPDNAEKLEDIIKILTIFEDRQRIR    641
WP_016631044    521  KDIIQFYRNE--YN-TEIVTLSGLEED--QFNASFSTYQDLLKCGLTR AELDHPDNAEKLEDIIKILTIFEDRQRIR    592
EMS75795        306  KKLQQFLSAN--YN-IEDAEILGVDKA---FNSSYATYHDFLDLAKPN ELLEQPEMNAMFEDIVKILTIFEDRMIR    381
WP_002373311    570  KDIIQFYRNE--YN-TEIVTLSGLEED--QFNASFSTYQDLLKCGLTR AELDHPDNAEKLEDIIKILTIFEDRQRIR    641
WP_002378009    570  KDIIQFYRNE--YN-TEIVTLSGLEED--QFNASFSTYQDLLKCGLTR AELDHPDNAEKLEDIIKILTIFEDRQRIR    641
WP_002407324    570  KDIIQFYRNE--YN-TEIVTLSGLEED--QFNASFSTYQDLLKCGLTR AELDHPDNAEKLEDIIKILTIFEDRQRIR    641
```

```
                         -continued
WP_002413717  570 KDIIQFYRNE--YN-TEIVTLSGLEED--QFNASFSTYQDLLKCGLTR AELDHPDNAEKLEDIIKILTIFEDRQRIR  641
WP_010775580  572 KDIIQFYRNE--YN-TEIVTLSGLEED--QFNASFSTYQDLLKCGLTR AELDHPDNAEKLEDIIKILTIFEDRQRIR  643
WP_010818269  570 KDIIQFYRNE--YN-TEIVTLSGLEED--QFNASFSTYQDLLKCGLTR AELDHPDNAEKLEDIIKILTIFEDRQRIR  641
WP_010824395  570 KDIIQFYRNE--YN-TEIVTLSGLEED--QFNASFSTYQDLLKCGLTR AELDHPDNAEKLEDIIKILTIFEDRQRIR  641
WP_016622645  570 KDIIQFYRNE--YN-TEIVTLSGLEED--QFNASFSTYQDLLKCGLTR AELDHPDNAEKLEDIIKILTIFEDRQRIR  641
WP_033624816  570 KDIIQFYRNE--YN-TEIVTLSGLEED--QFNASFSTYQDLLKCGLTR AELDHPDNAEKLEDIIKILTIFEDRQRIR  641
WP_033625576  570 KDIIQFYRNE--YN-TEIVTLSGLEED--QFNASFSTYQDLLKCGLTR AELDHPDNAEKLEDIIKILTIFEDRQRIR  641
WP_033789179  570 KDIIQFYRNE--YN-TEIVTLSGLEED--QFNASFSTYQDLLKCGLIR AELDHPDNAEKLEDIIKILTIFEDRQRIR  641
WP_002310644  567 KDLQEFLYLK--YD-IKHAELSGIEKA---FNASYTTYHDFLTMSENK QWLEDPELASMFEEIIKTLTVFEDREMIK  641
WP_002312694  568 KDLQEFLYLK--YD-IKHAELSGIEKA---FNASYTTYHDFLTMSENK QWLEDPELASMFEEIIKTLTVFEDREMIK  642
WP_002314015  568 KDLQEFLYLK--YD-IKHAELSGIEKA---FNASYTTYHDFLTMSENK QWLEDPELASMFEEIIKTLTVFEDREMIK  642
WP_002320716  568 KDLQEFLYLK--YD-IKHAELSGIEKA---FNASYTTYHDFLTMSENK QWLEDPELASMFEEIIKTLTVFEDREMIK  642
WP_002330729  567 KDLQEFLYLK--YD-IKHAELSGIEKA---FNASYTTYHDFLTMSENK QWLEDPELASMFEEIIKTLTVFEDREMIK  641
WP_002335161  568 KDLQEFLYLK--YD-IKHAELSGIEKA---FNASYTTYHDFLTMSENK QWLEDPELASMFEEIIKTLTVFEDREMIK  642
WP_002345439  568 KDLQEFLYLK--YD-IKHAELSGIEKA---FNASYTTYHDFLTMSENK QWLEDPELASMFEEIIKTLTVFEDREMIK  642
WP_034867970  562 KKLQNFLYTH--YH-IENAQIFGIEKA---FNASYSTYHDFMKLAKTN EWLEQPEMEPIFEDIVKILTIFEDRQMIK  637
WP_047937432  568 KDLQEFLYLK--YD-IKHAELSGIEKA---FNASYTTYHDFLTMSENK QWLEDPELASMFEEIIKTLTVFEDREMIK  642
WP_010720994  562 KKLQNFLYTH--YH-IENAQIFGIEKA---FNASYSTYHDFMKLAKTN EWLEQPEMEPIFEDIVKILTIFEDRQMIK  637
WP_010737004  562 KKLQNFLYTH--YH-IENAQIFGIEKA---FNASYSTYHDFMKLAKTN EWLEQPEMEPIFEDIVKILTIFEDRQMIK  637
WP_034700478  562 KKLQNFLYTH--YH-IENAQIFGIEKA---FNASYSTYHDFMKLAKTN EWLEQPEMEPIFEDIVKILTIFEDRQMIK  637
WP_007209003  564 KKLENYLRIE1---SISSPSVKGIEEQ---FNANFGTYLDLKKEDELH PYLDDEKYQDTLEEVIKVLIVFEDRSMIQ  634
WP_023519017  560 KQLRKFLELN--EQ-IDSTEIKGIETS---FNASYSTYHDLLKLS--- TLLDDPDMTTMFEEIIKILTIFEDREMIR  631
WP_010770040  564 KLLEKFLSNE--FG-LVDVAIKGIE-T--SFNAGYGTYHDFLKIGITR EQLDKEENSETLEEIVKILTVFEDRKMIR  634
WP_048604708  560 KDLSNFLRNE--YN-LDDVIIDGIE-N--KFNASFNTYHDFLKLKIDP KVLDDPANEPMFEEIVKILTIFEDRKMLR  630
WP_010750235  561 KKLQHFLSAN--YN-IEDAEILGVDKV---FNSSYATYHDFLELAKPY ELLEQPEMEEMFEDIVKIITIFEDREMVR  636
AII16583      601 KQLKEDYFKK--IECFDSVEISGVEDR---FNASLGTYHDLLKIIKDK DELDNEENEDILEDIVLTLTLFEDREMIE  672
WP_029073316  576 NAMKKWLVKNqyFSNTDDIKIEGFQKEn-ACSTSLTPWIDFTKIFGEI ----NNSNYELIEKIIYDVTVFEDKKILR  647
WP_031589969  576 NAMKKWLVKNqyFSNTDDIKIEGFQKEn-ACSTSLTPWIDFTKIFGKI ----NESNYDFIEKIIYDVTVFEDKKILR  647
KDA45870      558 KMVIKHLKVV--MPAIRIQALKGLDNGK--FNASYGTYKDLVDMGVAP ELLNDEVNSEKWEDIIKTLTIFEGRKLIK  630
WP_039099354  579 KNIQDYLVSEK--RYASRPAITGLSDEnk-FNSRLSTYHDLKTIVGDA --VDDVDKQADLEKCIEWSTIFEDGKIYS  650
AKP02966      561 KKLTKWLIAQg---YYKNPILIGLSQKd-EFNSTLTTYLDMKKIFGSS -FMENNKNYNQIEELIEWLTIFEDKQILN  632
WP_010991369  567 KDLELFLRNM--SH-VESPTIEGLE-D--SFNSSYSTYHDLLKVGIKQ EILDNPVNTEMLENIVKILTVFEDKRMIK  637
WP_033838504  567 KDLELFLRNM--SH-VESPTIEGLE-D--SENSSYSTYHDLLKVGIKQ EILDNPVNTEMLENIVKILTVFEDKRMIK  637
EHN60060      570 KDLELFLRNM--SH-VESPTIEGLE-D--SFNSSYSTYHDLLKVGIKQ EILDNPVNTEMLENIVKILTVFEDKRMIK  640
EFR89594      336 KDLELFLRNM--SH-VESPTIEGLE-D--SFNSSYSTYHDLLKVGIKQ EILDNPVNTEMLENIVKILTVFEDKRMIK  406
WP_038409211  567 KDLERFLYTI--NH-IESPTIEGVE-D--AFNSSFATYHDLQKGGVTQ EILDNPLNADMLEEIVKILTVFEDKRMIK  637
EFR95520      186 KDLERFLYTI--NH-IESPTIEGVE-D--AFNSSFATYHDLQKGGVTQ EILDNPLNADMLEEIVKILTVFEDKRMIK  256
WP_003723650  567 KDLELFLRNI--NH-IESPTIEGLE-D--SFNASYATYHDLLKVGMKQ EILDNPLNTEMLEDIVKILTVFEDKPMIK  637
WP_003727705  567 KDLELFLRNI--NH-IESPTIEGLE-D--SFNASYATYHDLLKVGLKQ EILDNPLNTEILEDIVKILTVFEDKRMIK  637
WP_003730785  567 KDLELFLRNI--NH-IESPTIEGLE-D--SFNASYATYHDLLKVGLKQ EILDNPLNTEILEDIVKILTVFEDKRMIK  637
WP_003733029  567 KDLELFLRNI--NQ-IESPTIEGLE-D--SFNASYATYHDLLKVGMKQ EILDNPLNTEMLEDIVKILTVFEDKRMIK  637
```

-continued

```
WP_003739838   567  KDLEQFLRNM--SH-IESPTIEGLE-D--SENSSYATYHDLLKVGIKQ EVLENPLNTEMLEDIVKILTVFEDKRMIK   637
WP_014601172   567  KDLELFLRNI--NH-IESPTIEGLE-D--SFNASYATYHDLLKVGMKQ EILDNPLNTEMLEDIVKILTVFEDKPMIK   637
WP_023548323   567  KDLELFLRNI--NH-VESPTIEGLE-D--SFNASYATYHDLMKVGIKQ EILDNPLNTEMLEDIVKILTVFEDKRMIK   637
WP_031665337   567  KDLELFLRNI--NQ-IESPTIEGLE-D--SFNASYATYHDLLKVGMKQ EILDNPLNTEMLEDIVKILTVFEDKRMIK   637
WP_031669209   567  KDLELFLRNI--NQ-IESPTIEGLE-D--SFNASYATYHDLLKVGMKQ EILDNPLNTEMLEDIVKILTVFEDKRMIK   637
WP_033920898   567  KDLELFLRNI--NH-VESPTIEGLE-D--SFNASYATYHDLMKVGIKQ EILDNPLNTEMLEDIVKILTVFEDKRMIK   637
AKI42028       570  KDLELFLRNI--NH-IESPTIEGLE-D--SFNASYATYHDLLKVGMKQ EILDNPLNTEMLEDIVKILTVFEDKPMIK   640
AKI50529       570  KDLELFLRNI--NH-VESPTIEGLE-D--SFNASYATYHDLMKVGIKQ EILDNPLNTEMLEDIVKILTVFEDKRMIK   640
EFR83390        15  KDLELFLRNI--NQ-IESPTIEGLE-D--SFNASYATYHDLLKVGMKQ EILDNPLNTEMLEDIVKILTVFEDKRMIK    85
WP_046323366   567  KDLELFLYNM--NH-VESPTVEGVE-D--AFNSSFTTYHDLQKVGVPQ EILDDPLNTEMLEEIIKILTVFEDKRMIN   637
AKE81011       578  KQLKEDYFKK--IECFDSVEISGVEDR---FNASLGTYHDLLKIIKDK DELDNEENEDILEDIVLTLTLFEDREMIE   649
CUO82355       572  KKLKNWLVNNqcCR--KDAEIKGFQKEn-QFSTSLTPWIDFTNIFGKI ----DQSNEDLIEKIIYDLTVFEDKKIMK   641
WP_033162887   573  KKLKDWLVTHqyYDINEELKIEGYQKDl-QFSTSLAPWIDFTKIFGEI ----NASNYQLIEKIIYDISIFEDKKILK   644
AGZ01981       595  KQLKEDYFKK--IECFDSVEISGVEDR---FNASLGTYHDLLKIIKDK DELDNEENEDILEDIVLTLTLFEDREMIE   666
AKA60242       562  KQLKEDYFKK--IECFDSVEISGVEDR---FNASLGTYHDLLKIIKDK DFLDNEENEDILEDIVLTLTLFEDREMIE   633
AKS40380       562  KQLKEDYFKK--IECFDSVEISGVEDR---FNASLGTYHDLLKIIKDK DELDNEENEDILEDIVLTLTLFEDREMIE   633
4UN5_B         566  KQLKEDYFKK--IECFDSVEISGVEDR---FNASLGTYHDLLKIIKDK DELDNEENEDILEDIVLTLTLFEDREMIE   637
WP_010922251   634  ERLKTYAHLFDDKVMKQLKR-RRYTGWGRLSRKLINGIRDK QSGKTILDFLK -DGf---ANRNFMQLIHDDSL      702
WP_039695303   638  ERLQKYSDIFTANQLKKLER-RHYTGWGRLSYKLINGIRNK ENNKTILDYLI DDG---SANRNFMQLINDDTL      706
WP_045635197   633  QRLAQYDSLEDEKVIKALTR-RHYTGWGKLSAKLINGICDK QTGNTILDYLI DDG---KINRNFMQLINDDGL      701
5AXW_A         369  EELTNLNSELTQEEIEQISNlKGYTGTHNLSLKAINLILDE ---------LW -------TNDNQIAIFNRLKL      426
WP_009880683   318  ERLKTYAHLFDDKVMKQLKR-RRYTGWGRLSRKLINGIRDK QSGKTILDFLK -DGf---ANRNFMQLIHDDSL      386
WP_010922251   634  ERLKTYAHLFDDKVMKQLKR-RRYTGWGRLSRKLINGIRDK QSGKTILDFLK -DGf---ANRNFMQLIHDDSL      702
WP_011054416   634  ERLKTYAHLFDDKVMKQLKR-RRYTGWGRLSRKLINGIRDK QSGKTILDFLK -DGf---ANRNFMQLIHDDSL      702
WP_011284745   634  ERLKTYAHLFDDKVMKQLKR-RRYTGWGRLSRKLINGIRDK QSGKTILDFLK -DGf---ANRNFMQLIHDDSL      702
WP_011285506   634  ERLKTYAHLFDDKVMKQLKR-RRYTGWGRLSRKLINGIRDK QSGKTILDFLK -DGf---ANRNFMQLIHDDSL      702
WP_011527619   634  ERLKTYAHLFDDKVMKQLKR-RRYTVWGRLSRKLINGIRDK QSGKTILDELK -DGf---ANRNFMQLIHDDSL      702
WP_012560673   634  ERLKTYAHLEDDKVMKQLKR-RRYTGWGRLSRKLINGIRDK QSGKTILDFLK -DGf---ANRNFMQLIHDDSL      702
WP_014407541   634  ERLKTYAHLFDDKVMKQLKR-RRYTGWGRLSRKLINGIRDK QSGKTILDFLK -DGf---ANRNFMQLIHDDSL      702
WP_020905136   634  ERLKTYAHLFDDKVMKQLKR-RRYTGWGRLSRKLINGIRDK QSGKTILDFLK -DGf---ANRNFMQLIHDDSL      702
WP_023080005   634  ERLKKYANLFDDKVMKQLKR-RHYTGWGRLSRKLINGIRDK QSGKTILDFLK -DGf---ANRNFMQLIHDDSL      702
WP_023610282   634  ERLKKYANLFDDKVMKQLKR-RHYTGWGRLSRKLINGIRDK QSGKTILDFLK -DGf---ANRNFMQLIHDDSL      702
WP_030125963   634  ERLKTYAHLFDDKVMKQLKR-RRYTGWGRLSRKLINGIRDK QSGKTILDFLK -DGf---ANRNFMQLIHDDSL      702
WP_030126706   634  ERLKTYAHLFDDKVMKQLKR-RRYTGWGRLSRKLINGIRDK QSGKTILDFLK -DGf---ANRNFMQLIHDDSL      702
WP_031488318   634  ERLKTYAHLFDDKVMKQLKR-RRYTGWGRLSRKLINGIRDK QSGKTILDFLK -DGf---ANRNFMQLIHDDSL      702
WP_032460140   634  ERLKTYAHLEDDKVMKQLKR-RRYTGWGRLSRKLINGIRDK QSGKTILDFLK -DGf---ANRNFMQLIHDDSL      702
WP_032461047   634  ERLKTYAHLFDDKVMKQLKR-RRYTGWGRLSRKLINGIRDK QSGKTILDFLK -DGf---ANRNFMQLIHDDSL      702
WP_032462016   634  ERLKTYAHLFDDKVMKQLKR-RRYTGWGRLSRKLINGIRDK QSGKTILDFLK -DGf---ANRNFMQLIHDDSL      702
WP_032462936   634  ERLKKYAHLFDDKVMKQLKR-RRYTGWGRLSRKLINGIRDK QSGKTILDFLK -DGf---ANRNFMQLIHDDSL      702
WP_032464890   634  ERLKTYAHLFDDKVMKQLKR-RRYTGWGRLSRKLINGIRDK QSGKTILDFLK -DGf---ANRNFMQLIHDDSL      702
```

-continued

```
WP_033888930  459 ERLKTYAHLFDDKVMKQLKR-RRYTGWGRLSRKLINGIRDK QSGKTILDFLK -DGf---ANRNFMQLIHDDSL  702

WP_038431314  634 ERLKTYAHLFDDKVMKQLKR-RRYTGWGRLSRKLINGIRDK QSGKTILDFLK -DGf---ANRNFMQLIHDDSL  702

WP_038432938  634 ERLKKYANLFDDKVMKQLKR-RHYTGWGRLSRKLINGIRDK QSGKTILDFLK -DGf---ANRNFMQLIHDDSL  702

WP_038434062  634 ERLKTYAHLFDDKVMKQLKR-RRYTGWGRLSRKLINGIRDK QSGKTILDELK -DGf---ANRNFMQLIHDDSL  702

BAQ51233      545 ERLKTYAHLFDDKVMKQLKR-RRYTGWGRLSRKLINGIRDK QSGKTILDFLK -DGf---ANRNFMQLIHDDSL  613

KGE60162          ----------------------------------------------------------------------

KGE60856          ----------------------------------------------------------------------

WP_002989955  634 ERLKTYAHLFDDKVMKQLKR-RRYTGWGRLSRKLINGIRDK QSGKTILDFLK -DGf---ANRNFMQLIHDDSL  702

WP_003030002  635 QRLQKYSDIFTKAQLKKLER-RHYTGWGRLSYKLINGIRNK ENKKTILDYLI DDG---YANRNFMQLINDDAL  703

WP_003065552  638 ERLQKYSDIFTADQLKKLER-RHYTGWGRLSYKLINGIRNK ENNKTILDYLI DDG---SANRNFMQLINDDTL  706

WP_001040076  633 KRLDIYKDFFTESQLKKLYR-RHYTGWGRLSAKLINGIRNK ENQKTILDYLI DDG---SANRNFMQLIKDAGL  701

WP_001040078  636 KRLENYKDLFTESQLKKLYR-RHYTGWGRLSAKLINGIRDK ESQKTILDYLI DDG---RSNRNFMQLINDDGL  704

WP_001040080  636 KRLENYKDLFTESQLKKLYR-RHYTGWGRLSAKLINGIRDK ESQKTILDYLI DDG---RSNRNFMQLINDDGL  704

WP_001040081  636 KRLENYKDLFTESQLKKLYR-RHYTGWGRLSAKLINGIRDK ESQKTILDYLI DDG---RSNRNFMQLINDDGL  704

WP_001040083  636 KRLENYKDLFTESQLKKLYR-RHYTGWGRLSAKLINGIRDK ESQKTILDYLI DDG---RSNRNFMQLINDDGL  704

WP_001040085  636 KRLENYKDLFTESQLKKLYR-RHYTGWGRLSAKLINGIRDK ESQKTILDYLI DDG---RSNRNFMQLINDDGL  704

WP_001040087  636 KRLENYKDLFTESQLKKLYR-RHYTGWGRLSAKLINGIRDK ESQKTILDYLI DDG---RSNRNFMQLINDDGL  704

WP_001040088  636 KRLENYKDLFTESQLKKLYR-RHYTGWGRLSAKLINGIRDK ESQKTILDYLI DDG---RSNRNFMQLINDDGL  704

WP_001040089  636 KRLENYKDLFTESQLKKLYR-RHYTGWGRLSAKLINGIRDK ESQKTILDYLI DDG---RSNRNFMQLINDDGL  704

WP_001040090  636 KRLENYKDLFTESQLKKLYR-RHYTGWGRLSAKLINGIRDK ESQKTILDYLI DDG---RSNRNFMQLINDDGL  704

WP_001040091  636 KRLENYKDLFTESQLKKLYR-RHYTGWGRLSAKLINGIRDK ESQKTILDYLI DDG---RSNRNFMQLINDDGL  704

WP_001040092  636 KRLENYKDLFTESQLKKLYR-RHYTGWGRLSAKLINGIRDR ESQKTILDYLI SDG---RANRNFMQLINDDGL  704

WP_001040094  633 KRLDIYKDFFTESQLKKLYR-RHYTGWGRLSAKLINGIRNK ENQKTILDYLI DDG---SANRNFMQLIKDAGL  701

WP_001040095  633 KRLDIYKDFFTESQLKKLYR-RHYTGWERLSAKLINGIRNK ENQKTILDYLI DDG---SANRNFMQLIKDAGL  701

WP_001040096  633 KRLDIYKDFFTESQLKKLYR-RHYTGWGRLSAKLINGIRNK ENQKTILDYLI DDG---SANRNFMQLIKDAGL  701

WP_001040097  633 KRLDIYKDFFTESQLKKLYR-RHYTGWGRLSAKLINGIRNK ENQKTILDYLI DDG---SANRNFMQLIKDAGL  701

WP_001040098  633 KRLDIYKDFFTESQLKKLYR-RHYTGWGRLSAKLINGIRNK ENQKTILDYLI DDG---SANRNFMQLIKDAGL  701

WP_001040099  633 KRLDIYKDFFTESQLKKLYR-RHYTGWGRLSAKLINGIRNK ENQKTILDYLI DDG---SANRNFMQLIKDAGL  701

WP_001040100  633 KRLDIYKDFFTESQLKKLYR-RHYTGWGRLSAKLINGIRNK ENQKTILDYLI DDG---SANRNFMQLIKDAGL  701

WP_001040104  636 KRLENYKDLFTESQLKKLYR-RHYTGWGRLSAKLINGIRDK ESQKTILDYLI DDG---RSNRNFMQLINDDGL  704

WP_001040105  636 KRLENYKDLFTESQLKKLYR-RHYTGWGRLSAKLINGIRDK ESQKTILDYLI DDG---RSNRNFMQLINDDGL  704

WP_001040106  636 KRLENYKDLFTESQLKKLYR-RHYTGWGRLSAKLINGIRDK ESQKTILDYLI SDG---RANRNFMQLIHDDGL  704

WP_001040107  636 KRLENYKDLFTESQLKKLYR-RHYTGWGRLSAKLINGIRDK ESQKTILDYLI SDG---RANRNFMQLIHDDGL  704

WP_001040108  636 KRLENYKDLFTESQLKKLYR-RHYTGWGRLSAKLINGIRDK ESQKTILDYLI SDG---RANRNFMQLIHDDGL  704

WP_001040109  636 KRLENYKDLFTESQLKKLYR-RHYTGWGRLSAKLINGIRDK ESQKTILDYLI SDG---RANRNFMQLIHDDGL  704

WP_001040110  636 KRLENYKDLFTESQLKKLYR-RHYTGWGRLSAKLINGIRDK ESQKTILDYLI SDG---RANRNFMQLIHDDGL  704

WP_015058523  636 KRLENYKDLFTESQLKKLYR-RHYTGWGRLSAKLINGIRDR ESQKTILDYLI SDG---RANRNFMQLINDDGL  704

WP_017643650  633 KRLDIYKDFFTESQLKKLYR-RHYTGWGRLSAKLINGIRNK ENQKTILDYLI DDG---SANRNFMQLIKDAGL  701

WP_017647151  636 KRLENYKDLFTESQLKKLYR-RHYTGWGRLSAKLINGIRDK ESQKTILDYLI DDG---KSNRNFMQLIHDDGL  704

WP_017648376  636 KRLENYKDLFTESQLKKLYR-RHYTGWGRLSAKLINGIRDK ESQKTILDYLI DDG---KSNRNFMQLIHDDGL  704
```

-continued

| | | | |
|---|---|---|---|
| WP_017649527 | 636 | KRLENYKDLFTESQLKKLYR-RHYTGWGRLSAKLINGIRDK ESQKTILDYLI DDG---RSNRNFMQLINDDGL | 704 |
| WP_017771611 | 636 | KRLENYKDLFTESQLKKLYR-RHYTGWGRLSAKLINGIRDK ESQKTILDYLI SDG---RANRNFMQLIHDDGL | 704 |
| WP_017771984 | 636 | KRLENYKDLFTESQLKKLYR-RHYTGWGRLSAKLINGIRDK ESQKTILDYLI DDG---RSNRNFMQLINDDGL | 704 |
| CFQ25032 | 636 | KRLENYKDLFTESQLKKLYR-RHYTGWGRLSAKLINGIRDK ESQKTILDYLI DDG---RSNRNFMQLINDDGL | 704 |
| CFV16040 | 636 | KRLENYKDLFTESQLKKLYR-RHYTGWGRLSAKLINGIRDK ESQKTILDYLI DDG---RSNRNFMQLINDDGL | 704 |
| KLJ37842 | 636 | KRLENYKDLFTESQLKKLYR-RHYTGWGRLSAKLINGIRDK ESQKTILDYLI DDG---RSNRNFMQLINDDGL | 704 |
| KLJ72361 | 636 | KRLENYKDLFTESQLKKLYR-RHYTGWGRLSAKLINGIRDK ESQKTILDYLI DDG---RSNRNFMQLINDDGL | 704 |
| KLL20707 | 636 | KRLENYKDLFTESQLKKLYR-RHYTGWGRLSAKLINGIRDK ESQKTILDYLI DDG---RSNRNEMQLINDDGL | 718 |
| KLL42645 | 636 | KRLENYKDLFTESQLKKLYR-RHYTGWGRLSAKLINGIRDK ESQKTILDYLI SDG---RANRNFMQLIHDDGL | 704 |
| WP_047207273 | 636 | KRLENYKDLFTESQLKKLYR-RHYTGWGRLSAKLINGIRDK ESQKTILDYLI DDG---RSNRNFMQLINDDGL | 704 |
| WP_047209694 | 633 | KRLDIYKDFFTESQLKKLYR-RHYTGWGRLSAKLINGIRNK ENQKTILDYLI DDG---SANRNEMQLIKDAGL | 701 |
| WP_050198062 | 636 | KRLENYKDLFTESQLKKLYR-RHYTGWGRLSAKLINGIRDK ESQKTILDYLI DDG---RSNRNFMQLINDDGL | 704 |
| WP_050201642 | 636 | KRLENYKDLFTESQLKKLYR-RHYTGWGRLSAKLINGIRDK ESQKTILDYLI DDG---RSNRNFMQLINDDGL | 704 |
| WP_050204027 | 636 | KRLENYKDLFTESQLKKLYR-RHYTGWGRLSAKLINGIRDK ESQKTILDYLI SDG---RANRNFMQLIHDDGL | 704 |
| WP_050881965 | 636 | KRLENYKDLFTESQLKKLYR-RHYTGWGRLSAKLINGIRDK ESQKTILDYLI DDG---RSNRNFMQLINDDGL | 704 |
| WP_050886065 | 636 | KRLENYKDLFTESQLKKLYR-RHYTGWGRLSAKLINGIRDK ESQKTILDYLI DDG---RSNRNFMQLINDDGL | 704 |
| AHN30376 | 636 | KRLENYKDLFTESQLKKLYR-RHYTGWGRLSAKLINGIRDR ESQKIILDYLI SDG---RANRNFMQLINDDGL | 704 |
| EAO78426 | 636 | KRLENYKDLFTESQLKKLYR-RHYTGWGRLSAKLINGIRDK ESQKTILDYLI DDG---RSNRNFMQLINDDGL | 704 |
| CCW42055 | 636 | KRLDIYKDFFTESQLKKLYR-RHYTGWGRLSAKLINGIRNK ENQKTILDYLI DDG---SANRNFMQLIKDAGL | 704 |
| WP_003041502 | 635 | QRLQKYSDIFTKAQLKKLER-RHYTGWGRLSYKLINGIRNK ENKKTILDYLI DDG---YANRNFMQLINDDAL | 703 |
| WP_037593752 | 636 | QRLQKYSDIFTKAQLKKLER-RHYTGWGRLSYKLINGIRNK ENKKTILDYLI DDG---YANRNFMQLINDDAL | 704 |
| WP_049516684 | 636 | QRLQKYSDIFTTQQLKKLER-RHYTGWGRLSYKLINGIRNK ENKKTILDYLI DDG---YANRNFMQLINDDAL | 704 |
| GAD46167 | 635 | QRLQKYSDIFTKAQLKKLER-RHYTGWGRLSYKLINGIRNK ENKKTILDYLI DDG---YANRNFMQLINDDAL | 703 |
| WP_018363470 | 636 | QRLQKYSDIFTKQQLKKLER-RHYTGWGRLSYKLINGIRNK ENNKTILDYLI DDG---SANRNFMQLINDDAL | 704 |
| WP_003043819 | 644 | ERLKTYAHLFDDKVMKQLKR-RHYTGWGRLSRKMINGIRDK QSGKTILDFLK -DGf---SNRNFMQLIHDDSL | 712 |
| WP_006269658 | 635 | QRLQKYSDIFTKAQLKKLER-RHYTGWGRLSYKLINGIRNK ENKKTILDYLI DDG---YANRNFMQLINDDAL | 703 |
| WP_048800889 | 635 | QRLQKYSDIFTKAQLKKLER-RHYTGWGRLSYKLINGIRNK ENNKTILEYLV DDG---YANRNFMQLINDDTL | 703 |
| WP_012767106 | 634 | ERLKKYANLFDDKVMKQLKR-RHYTGWGRLSRKLINGIRDK QSGKTILDFLK -DGf---ANRNFMQLINDDSL | 702 |
| WP_014612333 | 634 | ERLKKYANLFDDKVMKQLKR-RHYTGWGRLSRKLINGIRDK QSGKTILDFLK -DGf---ANRNFMQLINDDSL | 702 |
| WP_015017095 | 634 | ERLKTYAHLFDDKVMKQLKR-RHYTGWGRLSRKLINGIRDK QSGKTILDFLK -DGf---ANRNFIQLIHDDSL | 702 |
| WP_015057649 | 634 | ERLKKYANLFDDKVMKQLKR-RHYTGWGRLSRKLINGIRDK QSGKTILDFLK -DGf---ANRNFMQLINDDSL | 702 |
| WP_048327215 | 634 | ERLKTYAHLFDDKVMKQLKR-RHYTGWGRLSRKLINGIRDK QSGKTILDFLK -DGf---ANRNFIQLIHDDSL | 702 |
| WP_049519324 | 634 | ERLKTYAHLFDDKVMKQLKR-RHYTGWGRLSRKLINGIRDK QSGKTILDFLK -DGf---ANRNFIQLIHDDSL | 702 |
| WP_012515931 | 634 | KRLDQYAHLFDKVVLNKLER-HHYTGWGRLSGKLINGIRDK QSGKTILDFLK -DGf---ANRNFMQLIHDSEL | 702 |
| WP_021320964 | 634 | KRLDQYAHLFDKVVLNKLER-HHYTGWGRLSGKLINGIRDK QSGKTILDFLK -DGf---ANRNFMQLIHDSEL | 702 |
| WP_037581760 | 634 | KRLDQYAHLFDKVVLNKLER-HHYTGWGRLSGKLINGIRDK QSGKTILDFLK -DGf---ANRNFMQLIHDSEL | 702 |
| WP_004232481 | 635 | ERLQKYSDIFTSQQLKKLER-RHYTGWGRLSYKLINGIRNK ENNKTILDFLI DDG---DANRNFMQLINDDSL | 703 |
| WP_009854540 | 636 | ERLQKYSDIFTANQLKKLER-RHYTGWGRLSYKLINGIRNK ENNKTILDYLI DDG---SANRNFMQLINDDTL | 704 |
| WP_012962174 | 636 | QRLQKYSDIFTPQQLKKLER-RHYTGWGRLSYKLINGIRNK ENGKSILDYLI DDG---YANRNFMQLISDDTL | 704 |
| WP_039695303 | 638 | ERLQKYSDIFTANQLKKLER-RHYTGWGRLSYKLINGIRNK ENNKTILDYLI DDG---SANRNFMQLINDDTL | 706 |
| WP_014334983 | 635 | ERLQKYSDFFTSQQLKKLER-RHYTGWGRLSYKLINGIRNK ENNKTILDFLI DDG---HANRNFMQLINDESL | 703 |

-continued

```
WP_003099269  634  RRLVKYADVFEKSVLKKLKK-RHYTGWGRLSQKLINGIKDK QTGKTILGFLK -DGv---ANRNFMQLINDSSL  702
AHY15608      634  RRLVKYADVFEKSVLKKLKK-RHYTGWGRLSQKLINGIKDK QTGKTILGFLK -DGv---ANRNFMQLINDSSL  702
AHY17476      634  RRLVKYADVFEKSVLKKLKK-RHYTGWGRLSQKLINGIKDK QTGKTILGFLK -DGv---ANRNFMQLINDSSL  702
ESR09100           ---------------------------------------- ----------- --------------------
AGM98575      634  RRLVKYADVFEKSVLKKLKK-RHYTGWGRLSQKLINGIKDK QTGKTILGFLK -DGv---ANRNFMQLINDSSL  702
ALF27331      635  KRLENYSDLLIKEQVKNLER-RHYTGWGRLSAELIHGIRNK ESRKTILDYLI DDG---NSNRNFMQLINDDAL  703
WP_018372492  648  KRLSELNIPFENKIIKKLAR-KKYTGWGNLSRKLIDGIRNR ETNRTILGHLI DDGf---SNRNLMQLINDDGL  716
WP_045618028  634  QRLAHYASIFDEKVIKALTR-RHYTGWGKLSAKLINGIYDK QSKKTILDYLI DDG---EINRNFMQLINDDGL  702
WP_045635197  633  QRLAQYDSLFDEKVIKALTR-RHYTGWGKLSAKLINGICDK QTGNTILDYLI DDG---KINRNFMQLINDDGL  701
WP_002263549  635  KRLENYSDLLTKEQVKKLER-RHYTGWGRLSAELIHGIRNK ESRKTILDYLI DDG---NSNRNFMQLINDDAL  703
WP_002263887  635  KRLENYSDLLTKEQVKKLER-RHYTGWGRLSAELIHGIRNK ESRKTILDYLI DDG---NSNRNFMQLINDDAL  703
WP_002264920  635  KRLKNYSDLLTKEQLKKLER-RHYTGWGRLSAELIHGIRNK ESRKTILDYLI DDG---NSNRNFMQLINDDAL  703
WP_002269043  635  KRLKNYSDLLTKEQLKKLER-RHYTGWGRLSAELIHGIRNK ESRKTILDYLI DDG---NSNRNFMQLINDDAL  703
WP_002269448  635  KRLENYSDLLTKEQVKKLER-RHYTGWGRLSAELIHGIRNK ESRKTILDYLI DDG---NSNRNEMQLINDDAL  703
WP_002271977  635  KRLENYSDLLTKEQVKKLER-RHYTGWGRLSAELIHGIRNK ESRKTILDYLI DDG---NSNRNFMQLINDDAL  703
WP_002272766  635  KRLENYSDLLTKEQVKKLER-RHYTGWGRLSAELIHGIRNK ESRKTILDYLI DDG---NSNRNFMQLINDDAL  703
WP_002273241  635  KRLENYSDLLTKEQVKKLER-RHYTGWGRLSAELIHGIRNK ESRKTILDYLI DDG---NSNRNFMQLINDDAL  703
WP_002275430  635  KRLENYSDLLTKEQVKKLER-RHYTGWGRLSAELIHGIRNK ESRKTLLDYLI DDG---NSNRNFMQLINDDAL  703
WP_002276448  635  KRLENYSDLLTKEQVKKLER-RHYTGWGRLSAELIHGIRNK ESRKTILDYLI DDG---NSNRNFMQLINDDAL  703
WP_002277050  636  QRLAKYADVFDKKVIDQLAR-RHYTGWGRLSAKLLNGIRDK QSCKTIMDYLI DDA---QSNRNLMQLITDDNL  704
WP_002277364  635  KRLENYSDLLTKEQVKKLER-RHYTGWGRLSAELIHGIRNK ESRKTILDYLI DDG---NSNRNFMQLINDDAL  703
WP_002279025  635  KRLKNYSDLLTKEQLKKLER-RHYTGWGRLSAELIHGIRNK ESRKTILDYLI DDG---NSNRNFMQLINDDAL  703
WP_002279859  635  KRLKNYSDLLTKEQLKKLER-RHYTGWGRLSAELIHGIRNK ESRKTILDYLI DDG---NSNRNEMQLINDDAL  703
WP_002280230  635  KRLENYSDLLTKEQVKKLER-RHYTGWGRLSAELIHGIRNK ESRKTILDYLI DDG---NSNRNFMQLINDDAL  703
WP_002281696  635  KRLENYSDLLTKEQVKKLER-RHYTGWGRLSAELIHGIRNK ESRKTILDYLI DDG---NSNRNFMQLINDDAL  703
WP_002282247  636  QRLAKYADVFDKKVIDQLAR-RHYTGWGRLSAKLLNGIRDK QSCKTIMDYLI DDA---QSNRNLMQLITDDNL  704
WP_002282906  635  KRLENYSDLLTKEQVKKLER-RHYTGWGRLSAELIHGIRNK ESRKTILDYLI DDG---NSNRNFMQLINDDAL  703
WP_002283846  635  KRLKNYSDLLTKEQLKKLER-RHYTGWGRLSAELIHGIRNK ESRKTILDYLI DDG---NSNRNFMQLINDDAL  703
WP_002287255  635  KRLENYSDLLTKEQVKKLER-RHYTGWGRLSAELIHGIRNK ESRKTILDYLI DDG---NSNRNFMQLINDDAL  703
WP_002288990  635  KRLKNYSDLLTKEQLKKLER-RHYTGWGRLSAELIHGIRNK ESRKTILDYLI DDG---NSNRNFMQLINDDAL  703
WP_002289641  635  KRLENYSDLLTKEQVKKLER-RHYTGWGRLSAELIHGIRNK ESRKTILDYLI DDG---NSNRNEMQLINDDAL  703
WP_002290427  635  KRLKNYSDLLTKEQLKKLER-RHYTGWGRLSAELIHGIRNK ESRKTILDYLI DDG---NSNRNFMQLINDDAL  703
WP_002295753  635  KRLENYSDLLTKEQVKKLER-RHYTGWGRLSAELIHGIRNK ESRKTILDYLI DDG---NSNRNFMQLINDDAL  703
WP_002296423  635  KRLKNYSDLLTKEQLKKLER-RHYTGWGRLSAELIHGIRNK ESRKTILDYLI DDG---NSNRNFMQLINDDAL  703
WP_002304487  645  QRLQKYSDIFTKAQLKKLER-RHYTGWGRLSYKLINGIRDK QSNKTILGYLI DDG---YSNRNFMQLINDDAL  713
WP_002305844  635  KRLENYSDLLTKEQVKKLER-RHYTGWGRLSAELIHGIRNK ESRKTILDYLI DDG---NSNRNFMQLINDDAL  703
WP_002307203  635  KRLENYSDLLTKEQVKKLER-RHYTGWGRLSAELIHGIRNK ESRKILLDYLI DDG---NSNRNFMQLINDDAL  703
WP_002310390  635  KRLKNYSDLLTKEQLKKLER-RHYTGWGRLSAELIHGIRNK ESRKTILDYLI DDG---NSNRNFMQLINDDAL  703
WP_002352408  635  KRLENYSDLLTKEQVKKLER-RHYTGWGRLSAELIHGIRNK ESRKTLLDYLI DDG---NSNRNFMQLINDDAL  703
WP_012997688  635  KRLENYSDLLTKEQVKKLER-RHYTGWGRLSAELIHGIRNK ESRKTILDYLI DDG---NSNRNFMQLINDDAL  703
```

-continued

| | | | |
|---|---|---|---|
| WP_014677909 | 635 KRLKNYSDLLTKEQLKKLER-RHYTGWGRLSAELIHGIRNK ESRKTILDYLI DDG---NSNRNFMQLINDDAL | 703 |
| WP_019312892 | 635 KRLENYSDLLTKEQVKKLER-RHYTGWGRLSAELIHGIRNK ESRKTILDYLI DDG---NSNRNEMQLINDDAL | 703 |
| WP_019313659 | 635 KRLENYSDLLTKEQVKKLER-RHYTGWGRLSAELIHGIRNK ESRKTILDYLI DDG---NSNRNFMQLINDDAL | 703 |
| WP_019314093 | 635 KRLENYSDLLTKEQVKKLER-RHYTGWGRLSAELIHGIRNK ESRKTLLDYLI DDG---NSNRNFMQLINDDAL | 703 |
| WP_019315370 | 635 KRLENYSDLLTKEQVKKLER-RHYTGWGRLSAELIHGIRNK ESRKTLLDYLI DDG---NSNRNFMQLINDDAL | 703 |
| WP_019803776 | 635 KRLENYSDLLTKEQVKKLER-RHYTGWGRLSAELIHGIRNK ESRKTILDYLI DDG---NSNRNFMQLINDDAL | 703 |
| WP_019805234 | 635 KRLKNYSDLLTKEQLKKLER-RHYTGWGRLSAELIHGIRNK ESRKTILDYLI DDG---NSNRNFMQLINDDAL | 703 |
| WP_024783594 | 635 KRLENYSDLLTKEQVKKLER-RHYTGWGRLSAELIHGIRNK ESRKTILDYLI DDG---NSNRNFMQLINDDAL | 703 |
| WP_024784288 | 636 QRLAKYADVEDKKVIDQLAR-RHYTGWGRLSAKLLNGIRDK QSCKTIMDYLI DDA---QSNRNLMQLITDDNL | 704 |
| WP_024784666 | 635 KRLENYSDLLTKEQVKKLER-RHYTGWGRLSAELIHGIRNK ESRKTILDYLI DDG---NSNRNFMQLINDDAL | 703 |
| WP_024784894 | 635 KRLENYSDLLTKEQVKKLER-RHYTGWGRLSAELIHGIRNK ESRKTILDYLI DDG---NSNRNFMQLINDDAL | 703 |
| WP_024786433 | 636 QRLAKYADVEDKKVIDQLAR-RHYTGWGRLSAKLLNGIRDK QSCKTIMDYLI DDA---QSNRNLMQLITDDNL | 704 |
| WP_049473442 | 635 KRLENYSDLLTKEQVKKLER-RHYTGWGRLSAELIHGIRNK ESRKTILDYLI DDG---NSNRNFMQLINDDAL | 703 |
| WP_049474547 | 635 KRLENYSDLLTKEQVKKLER-RHYTGWGRLSAELIHGIRNK ESRKTILDYLI DDG---NSNRNFMQLINDDAL | 703 |
| EMC03581 | 628 KRLENYSDLLTKEQVKKLER-RHYTGWGRLSAELIHGIRNK ESRKTILDYLI DDG---NSNRNFMQLINDDAL | 696 |
| WP_000428612 | 636 QRLAQYDSLFDEKVIKALTR-RHYTGWGKLSSKLINGIRDK QTGKTILDYLM DDG---YNNRNFMQLINDDEL | 704 |
| WP_000428613 | 634 QRLAQYDSLFDEKVIKALIR-RHYTGWGKLSAKLIDGICDK QTGNTILDYLI DDG---KNNRNFMQLINDDGL | 702 |
| WP_049523028 | 633 QRLNQYDSIFDEKVIKALTR-RHYTGWGKLSAKLIHGIRDK KTSKTILDYLI DDG---YSNRNFMQLINDDGL | 701 |
| WP_003107102 | 603 KRLSKYESIFDPSILKKLKK-RHYTGWGRLSQKLINGIRDK QTGKTILDELI -DGq---ANRNFMQLINDPSL | 671 |
| WP_054279288 | 636 NRLAVYEDLFDQNVLKQLKR-RHYTGWGRLSKQLINGMRDK HTGKTILDFLK -DGf---INRNFMQLINDDNL | 704 |
| WP_049531101 | 634 QRLAQYASIFDEKVIKTLTR-RHYTGWGKLSAKLINCIRDR KTGKTILDYLI DDG---YNNRNFMQLINDDGL | 702 |
| WP_049538452 | 634 QRLAQYDSIFDEKVIKALTR-RHYTGWGKLSAKLINGIRDK QTGKTILDYLI DDG---YSNRNFMQLINDDGL | 702 |
| WP_049549711 | 634 QRLAQYDSLFDKKVIKALTR-RHYTGWGKLSAKLINGICDK QTGNTILDYLI DDG---EINRNFMQLINDDGL | 702 |
| WP_007896501 | 637 KRLAKYANLFEKSVLKKLRK-RHYRGWGRLSRQLIDGMKDK ASGKTILDFLK -DDf---ANRNFIQLINDSSL | 705 |
| EFR44625 | 589 KRLAKYANLFEKSVLKKLRK-RHYRGWGRLSRQLIDGMKDK ASGKTILDFLK -DDf---ANRNFIQLINDSSL | 657 |
| WP_002897477 | 633 QRLAQYDTLFDEKVIKALTR-RHYTGWGKLSAKLINGIRDK QSGKTILDYLI DDD---KINRNFMQLINDDGL | 701 |
| WP_002906454 | 633 QRLAQYDTLFDEKVIKALTR-RHYTGWGKLSAKLINGIRDK QTGKTILEYLI DDG---DCNRNFMQLINDDGL | 701 |
| WP_009729476 | 634 QRLAQYDSLEDEKVIKALTR-RHYTGWGKLSAKLINGISDK QTGNTILDYLI DDG---EINRNFMQLINDDGL | 702 |
| COR24647 | 637 QRLLKYEDIFSKKVIANLTR-RHYTGWGRLSAKLINGIKDK HSRKTILDYLI DDG---HSNRNFMQLINDDNL | 705 |
| WP_000066813 | 636 QRLAQYDSLFDEKVIKALTR-RHYTGWGKLSAKLINGIRDK KSGKTILDYLI DDG---EINRNFMQLIHDDGL | 704 |
| WP_009754323 | 634 QRLAQYDSIFDEKVIKALTR-RHYTGWGKLSAKLINGICDK KTGKTILDYLI DDG---YNNRNFMQLINDDGL | 702 |
| WP_044674937 | 633 KRLEKYKDILTEEQRKKLER-RHYTGWGRLSAKLINGILDK VTRKTILGYLI DDG---TSNRNEMQLINDDTL | 701 |
| WP_044676715 | 635 KRLEKYKDVLTEEQRKKLER-RHYTGWGRLSAKLINGIRDK VTRKTILDYLI DDG---TSNRNFMQLINDDTL | 703 |
| WP_044680361 | 635 KRLEKYKDVLTEEQRKKLER-RHYTGWGRLSAKLINGIRDK VTRKTILDYLI DDG---TSNRNFMQLINDDTL | 703 |
| WP_044681799 | 633 KRLEKYKDILTEEQRKKLER-RHYTGWGRLSAKLINGILDK VTRKTILGYLI DDG---TSNRNFMQLINDDTL | 701 |
| WP_049533112 | 635 QRLQKYSDIFTKAQLKKLER-CHYTGWGRLSYKLINGIRNK ENKKTILDYLI DDG---YANRNFMQLINDDAL | 703 |
| WP_029090905 | 613 RKLSEYPQLTEQQQVQLAQV--RFRGWGRLSQRLINRIKTP EDHKLSINEIL ------QTNENFMQIIRNKDY | 682 |
| WP_006506696 | 638 RRLKKKYALPDDKVKQILKL--KYKDWSRLSKKLLDGIVAD SV--TVLDVLE -------SRLNLMEIINDKDL | 705 |
| AIT42264 | 634 ERLKTYAHLFDDKVMKQLKR-RRYTGWGRLSRKLINGIRDK QSGKTILDFLK -DGf---ANRNFMQLIHDDSL | 702 |
| WP_034440723 | 638 RQLMKFKDKLSEKAINQLSK-KHYTGWGQLSEKLINGIRDE QSNKTILDYLI DNGcpkNMNRNFMQLINDDTL | 710 |
| AKQ21048 | 634 ERLKTYAHLFDDKVMKQLKR-RRYTGWGRLSRKLINGIRDK QSGKTILDFLK -DGf---ANRNFMQLIHDDSL | 702 |

-continued

```
WP_004636532   634  KQLQTYSDTLSPEILKKLER-KHYTGWGRFSKKLINGLRDE GSNKTILDYLK DEGssgPTNRNFMQLIRDNTL  706

WP_002364836   642  TQLSTFKGQFSAEVLKKLER-KHYTGWGRLSKKLINGIYDK ESGKTILGYLI DDGvskHYNRNFMQLINDSQL  714

WP_016631044   593  TQLSTFKGQFSAEVLKKLER-KHYTGWGRLSKKLINGIYDK ESGKTILDYLV DDGVSKHYNRNFMQLINDSQL  665

EMS75795       382  TQLKKYQSVLGDGFFKKLVK-KHYTGWGRLSERLINGIRDK KINKTILDYLI DDDfpyNRNRNFMQLINDDSL  454

WP_002373311   642  TQLSTFKGQFSAEVLKKLER-KHYTGWGRLSKKLINGIYDK ESGKTILDYLV DDGvskHYNRNFMQLINDSQL  714

WP_002378009   642  TQLSTFKGQFSAEVLKKLER-KHYTGWGRLSKKLINGIYDK ESGKTILDYLI DDGVSKHYNRNFMQLINDSQL  714

WP_002407324   642  TQLSTFKGQFSAEVLKKLER-KHYTGWGRLSKKLINGIYDK ESGKTILDYLV DDGVSKHYNRNFMQLINDSQL  714

WP_002413717   642  TQLSTFKGQFSAEVLKKLER-KHYTGWGRLSKKLINGIYDK ESGKTILDYLV DDGvSkHYNRNFMQLINDSQL  714

WP_010775580   644  TQLSTFKGQFSEEVLKKLER-KHYTGWGRLSKKLINGIYDK ESGKTILDYLI DDGvSkHYNRNFMQLINDSQY  716

WP_010818269   642  TQLSTFKGQFSAEVLKKLER-KHYTGWGRLSKKLINGIYDK ESGKTILGYLI DDGVSKHYNRNFMQLINDSQL  714

WP_010824395   642  TQLSTFKGQFSAEVLKKLER-KHYTGWGRLSKKLINGIYDK ESGKTILDYLI DDGVSKHYNRNFMQLINDSQL  714

WP_016622645   642  TQLSTFKGQFSAEVLKKLER-KHYTGWGRLSKKLINGIYDK ESGKTILDYLV DDGvSkHYNRNFMQLINDSQL  714

WP_033624816   642  TQLSTFKGQFSAEVLKKLER-KHYTGWGRLSKKLINGIYDK ESGKTILDYLI DDGvskHYNRNFMQLINDSQL  714

WP_033625576   642  TQLSTFKGQFSAEVLKKLER-KHYTGWGRLSKKLINGIYDK ESGKTILDYLI DDGvskHYNRNFMQLINDSQL  714

WP_033789179   642  TQLSTFKGQFSEEVLKKLER-KHYTGWGRLSKKLINGIYDK ESGKTILDYLI DDGvskHYNRNFMQLINDSQL  714

WP_002310644   642  TRLSHHEATLGKHIIKKLTK-KHYTGWGRLSKELIQGIRDK QSNKTILDYLI DDDfphHRNRNFMQLINDDSL  714

WP_002312694   643  TRLSHHEATLGKHIIKKLTK-KHYTGWGRLSKELIQGIRDK QSNKTILDYLI DDDfphHRNRNFMQLINDDSL  715

WP_002314015   643  TRLSHHEATLGKHIIKKLTK-KHYTGWGRLSKELIQGIRDK QSNKTILDYLI DDDfphHRNRNFMQLINDDSL  715

WP_002320716   643  TRLSHHEATLGKHIIKKLTK-KHYTGWGRLSKELIQGIRDK QSNKTILDYLI DDDfphHRNRNFMQLINDDSL  715

WP_002330729   642  TRLSHHEATLGKHIIKKLTK-KHYTGWGRLSKELIQGIRDK QSNKTILDYLI DDDfphHRNRNFMQLINDDSL  714

WP_002335161   643  TRLSHHEATLGKHIIKKLTK-KHYTGWGRLSKELIQGIRDK QSNKTILDYLI DDDfphHRNRNFMQLINDDSL  715

WP_002345439   643  TRLSHHEATLGKHIIKKLTK-KHYTGWGRLSKELIQGIRDK QSNKTILDYLI DDDfphHRNRNCMQLINDDSL  715

WP_034867970   638  HQLSKYQEVFGEKLLKEFAR-KHYTGWGRFSAKLIHGIRDR KINKTILDYLI DDDvpaNRNRNLMQLINDEHL  710

WP_047937432   643  TRLSHHEATLGKHIIKKLTK-KHYTGWGRLSKELIQGIRDK QSNKTILDYLI DDDfphHRNRNFMQLINDDSL  715

WP_010720994   638  HQLSKYQEVFGEKLLKEFAR-KHYTGWGRFSAKLIHGIRDR KTNKTILDYLI DDDvpaNRNRNLMQLINDEHL  710

WP_010737004   638  HQLSKYQEVFGEKLLKEFAR-KHYTGWGRFSAKLIHGIRDR KINKTILDYLI DDDvpaNRNRNLMQLINDEHL  710

WP_034700478   638  HQLSKYQEVFGEKLLKEFAR-KHYTGWGRFSAKLIHGIRDR KINKTILDYLI DDDvpaNRNRNLMQLINDEHL  710

WP_007209003   635  NQLEQLPLNLSTKTIKALSR-RKYTGWGRLSARLIDGIHDK NSGKTILDYLI DESdsyIVNRNFMQLINDDHL  707

WP_023519017   632  EQLKPYETVLGLPAIKKLAK-KHYTGWGRLSEKMIQGMREK QSRKTILDYLI DDDfpcNRNRNFMQLINDDHL  704

WP_010770040   635  EQLKKYTYLFDEEVLKKLER-RHYTGWGRLSAKLLIGIKEK RTHKTILDYLI DDGgkqPINRNLMQLINDSDL  707

WP_048604708   631  EQLSKFSDRLSEKTIKDLER-RHYTGWGRLSAKLINGIHDK QSNKTILDYLI DDApkkNINRNFMQLINDNRL  703

WP_010750235   637  TQLKKYQRILGEEIFKKLVK-KKYTGWGRLSKRLINGIRDQ KTNKTILDYLI DDDfpyNRNRNFMQLINDDHL  709

AII16583       673  ERLKTYAHLEDDKVMKQLKR-RRYTGWGRLSRKLINGIRDK QSGKTILDFLK -DGf---ANRNFMQLIHDDSL  741

WP_029073316   648  RRLKKEYDLDEEKIKKILKL--KYSGWSRLSKKLLSGIKTK RTPETVLEVME -------TNMNLMQVINDEKL  717

WP_031589969   648  RRLKKEYDLDEEKIKKILKL--KYSGWSRLSKKLLSGIKTK RTPETVLEVME -------TNMNLMQVINDEKL  717

KDA45870       631  RRLENYRDFLGEDILRKLSR-KKYTGWGRLSAKLLDGIYDK KTHKTILDCLM EDYs-----QNFMQLINDDTY  698

WP_039099354   651  AKLNEIDWLTDQQRVQLAAK--RYRGWGRLSAKLLTQIVN- ANGQRIMDLLW -------TTDNFMRIVHSE--  712

AKP02966       633  EKLHSSNYSYTSDQIKKISN-MRYKGWGRLSKKILTCITTE TNTPKSLQLSN -DLm-wTTNNNFISIISNDKY  706

WP_010991369   638  EQLQQFSDVLDGVVLKKLER-RHYTGWGRLSAKLLMGIRDK QSHLTILDYLM DDG----LNRNLMQLINDSNL  706

WP_033838504   638  EQLQQFSDVLDGVVLKKLER-RHYTGWGRLSAKLLMGIRDK QSHLTILDYLM DDG----LNRNLMQLINDSNL  706
```

-continued

```
EHN60060         641  EQLQQFSDVLDGVVLKKLER-RHYTGWGRLSAKLLMGIRDK QSHLTILDYLM DDG----LNRNLMQLINDSNL    709
EFR89594         407  EQLQQFSDVLDGVVLKKLER-RHYTGWGRLSAKLLMGIRDK QSHLTILDYLM DDG----LNRNLMQLINDSNL    475
WP_038409211     638  EQLQSFSDVLDGTILKKLER-RHYTGWGRLSAKLLTGIRDK HSHLTILDYLM DDG----LNRNLMQLINDSNL    706
EFR95520         257  EQLQSFSDVLDGTILKKLER-RHYTGWGRLSAKLLTGIRDK HSHLTILDYLM DDG----LNRNLMQLINDSNL    325
WP_003723650     638  EQLQQFSDVLDGGVLKKLER-RHYTGWGRLSAKLLVGIREK QSHLTILDYLM DDG----LNRNLMQLINDSNL    706
WP_003727705     638  EQLEQFSDVLDGVVLKKLER-RHYTGWGRLSAKLLVGIRDK QSHLTILDYLM DDG----LNRNLMQLINDSNL    706
WP_003730785     638  EQLEQFSDVLDGVVLKKLER-RHYTGWGRLSAKLLVGIRDK QSHLTILDYLM DDG----LNRNLMQLINDSNL    706
WP_003733029     638  EQLQQFSDVLDGTVLKKLER-RHYTGWGRLSAKLLVGIRDK QSHLTILDYLM DDG----LNRNLMQLINDSNL    706
WP_003739838     638  EQLQQFSDVLDGAVLKKLER-RHYTGWGRLSAKLLVGIRDK QSHLTILDYLM DDG----LNRNLMQLINDSNL    706
WP_014601172     638  EQLQQFSDVLDGGVLKKLER-RHYTGWGRLSAKLLVGIREK QSHLTILDYLM DDG----LNRNLMQLINDSNL    706
WP_023548323     638  EQLQQFSDVLDGTVLKKLER-RHYTGWGRLSAKLLVGIRDK QSHLTILDYLM DDG----LNRNLMQLINDSNL    706
WP_031665337     638  EQLQQFSDVLDGVVLKKLER-RHYTGWGRLSAKLLVGIRDK QSHLTILEYLM DDG----LNRNLMQLINDSNL    706
WP_031669209     638  EQLQQFSDVLDGTVLKKLER-RHYTGWGRLSAKLLVGIRDK QSHLTILDYLM DDG----LNRNLMQLINDSNL    706
WP_033920898     638  EQLQQFSDVLDGTVLKKLER-RHYTGWGRLSAKLLVGIRDK QSHLTILDYLM DDG----LNRNLMQLINDSNL    706
AKI42028         641  EQLQQFSDVLDGGVLKKLER-RHYTGWGRLSAKLLVGIREK QSHLTILDYLM DDG----LNRNLMQLINDSNL    709
AKI50529         641  EQLQQFSDVLDGTVLKKLER-RHYTGWGRLSAKLLVGIRDK QSHLTILDYLM DDG----LNRNLMQLINDSNL    709
EFR83390          86  EQLQQFSDVLDGVVLKKLER-RHYTGWGRLSAKLLVGIRDK QSHLTILEYLM DDG----LNRNLMQLINDSNL    154
WP_046323366     638  ERLQEFSNVLDEAVLKKLER-RHYTGWGRLSAKLLIGIRDK ESHLTILDYLM DDK----HNRNLMQLINDSNL    706
AKE81011         650  ERLKTYAHLFDDKVMKQLKR-RRYTGWGRLSRKLINGIRDK QSGKTILDFLK -DGf---ANRNFMQLIHDDSL    718
CUO82355         642  RRLKKKYALPDDKIKQILKL--KYKDWSRLSKKLLDGIVAD SV--TVLDVLE -------SRLNLMEIINDKEL    709
WP_033162887     645  RRLKKVYQLDDLLVDKILKL--NYTGWSRLSEKLLTGMTAD KA--TVLFVLE -------SNKNLMEIINDEKL    712
AGZ01981         667  ERLKTYAHLFDDKVMKQLKR-RRYTGWGRLSRKLINGIRDK QSGKTILDFLK -DGf---ANRNFMQLIHDDSL    735
AKA60242         634  ERLKTYAHLEDDKVMKQLKR-RRYTGWGRLSRKLINGIRDK QSGKTILDFLK -DGf---ANRNFMQLIHDDSL    702
AKS40380         634  ERLKTYAHLEDDKVMKQLKR-RRYTGWGRLSRKLINGIRDK QSGKTILDFLK -DGf---ANRNFMQLIHDDSL    702
4UN5_B           638  ERLKTYAHLEDDKVMKQLKR-RRYTGWGRLSRKLINGIRDK QSGKTILDFLK -DGf---ANRNFMQLIHDDSL    706
WP_010922251     703  TFKEDIQKAQVSG-QGDS-LHEHIANLAGSPAIKKGILQTVKVVDELVKVMGrHKPENIVIEMARENQ TTQKGQKNS    777
WP_039695303     707  PFKQIIQKSQVVG-DVDD-IEAVVHDLPGSPAIKKGILQSVKIVDELVKVMG-GNPDNIVIEMARENQ TTNRGRSQS    780
WP_045635197     702  SFKEIIQKAVIG-KTDD-VKQVVQELSGSPAIKKGILQSIKIVDELVKVMG-HAPESIVIEMARENQ TTARGKKNS    775
5AXW_A           427  VPKKVDLSQQKEI---PT---TLVDDFILSPVVKRSFIQSIKVINAIIKKYG--LPNDIIIELAREKN --------S    487
WP_009880683     387  TFKEDLQKAQVSG-QGDS-LHEHIANLAGSPAIKKGILQTVKVVDELVKVMGrHKPENIVIEMARENQ TTQKGQKNS    461
WP_010922251     703  TFKEDIQKAQVSG-QGDS-LHEHIANLAGSPAIKKGILQTVKVVDELVKVMGrHKPENIVIEMARENQ TTQKGQKNS    777
WP_011054416     703  TFKEDIQKAQVSG-QGDS-LHEHIANLAGSPAIKKGILQTVKVVDELVKVMGrHKPENIVIEMARENQ TTQKGQKNS    777
WP_011284745     703  TFKEDIQKAQVSG-QGDS-LHEHIANLAGSPAIKKGILQTVKVVDELVKVMGrHKPENIVIEMARENQ TTQKGQKNS    777
WP_011285506     703  TFKEDIQKAQVSG-QGDS-LHEHIANLAGSPAIKKGILQTVKVVDELVKVMGrHKPENIVIEMARENQ TTQKGQKNS    777
WP_011527619     703  TFKEDIQKAQVSG-QGDS-LHEHIANLAGSPAIKKGILQTVKVVDELVKVMGrHKPENIVIEMARENQ TTQKGQKNS    777
WP_012560673     703  TFKEDLQKAQVSG-QGDS-LHEHIANLAGSPAIKKGILQTVKVVDELVKVMGrHKPENIVIEMARENQ TTQKGQKNS    777
WP_014407541     703  TFKEDIQKAQVSG-QGHS-LHEQIANLAGSPAIKKGILQTVKIVDELVKVMG-HKPENIVIEMARENQ TTQKGQKNS    776
WP_020905136     703  TFKEDIQKAQVSG-QGDS-LHEHIANLAGSPAIKKGILQTVKVVDELVKVMGrHKPENIVIEMARENQ TTQKGQKNS    777
WP_023080005     703  TFKEAIQKAQVSG-QGHS-LHEQIANLAGSPAIKKGILQTVKIVDELVKVMG-HKPENIVIEMARENQ TTQKGQKNS    776
WP_023610282     703  TFKEAIQKAQVSG-QGHS-LHEQIANLAGSPAIKKGILQTVKIVDELVKVMG-HKPENIVIEMARENQ TTQKGQKNS    776
```

-continued

```
WP_030125963   703  TFKEDLQKAQVSG-QGDS-LHEHIANLAGSPAIKKGILQTVKVVDELVKVMGrHKPENIVIEMARENQ TTQKGQKNS   777
WP_030126706   703  TFKEDIQKAQVSG-QGDS-LHEHIANLAGSPAIKKGILQTVKVVDELVKVMGrHKPENIVIEMARENQ TTQKGQKNS   777
WP_031488318   703  TFKEDIQKAQVSG-QGDS-LHEHIANLAGSPAIKKGILQTVKVVDELVKVMGrHKPENIVIEMARENQ TTQKGQKNS   777
WP_032460140   703  TFKEDLQKAQVSG-QGDS-LHEHIANLAGSPAIKKGILQTVKVVDELVKVMGrHKPENIVIEMARENQ TTQKGQKNS   777
WP_032461047   703  TFKEDLQKAQVSG-QGDS-LHEHIANLAGSPAIKKGILQTVKVVDELVKVMGrHKPENIVIEMARENQ TTQKGQKNS   777
WP_032462016   703  TFKEDIQKAQVSG-QGDS-LHEHIANLAGSPAIKKGILQTVKVVDELVKVMGrHKPENIVIEMARENQ TTQKGQKNS   777
WP_032462936   703  TFKEDIQKAQVSG-QGDS-LHEHIANLAGSPAIKKGILQTVKVVDELVKVMGrHKPENIVIEMARENQ TTQKGQKNS   777
WP_032464890   703  TFKEDIQKAQVSG-QGDS-LHEHIANLAGSPAIKKGILQTVKVVDELVKVMGrHKPENIVIEMARENQ TTQKGQKNS   777
WP_033888930   528  TFKEDIQKAQVSG-QGDS-LHEHIANLAGSPAIKKGILQTVKVVDELVKVMGrHKPENIVIEMARENQ TTQKGQKNS   602
WP_038431314   703  TFKEDIQKAQVSG-QGDS-LHEHIANLAGSPAIKKGILQTVKVVDELVKVMGrHKPENIVIEMARENQ TTQKGQKNS   777
WP_038432938   703  TFKEAIQKAQVSG-QGHS-LHEQIANLAGSPAIKKGILQTVKIVDELVKVMG-HKPENIVIEMARENQ TTQKGQKNS   776
WP_038434062   703  TFKEDIQKAQVSG-QGDS-LHEHIANLAGSPAIKKGILQTVKIVDELVKVMGrHKPENIVIEMARENQ TTQKGQKNS   777
BAQ51233       614  TFKEDIQKAQVSG-QGDS-LHEHIANLAGSPAIKKGILQTVKVVDELVKVMGrHKPENIVIEMARENQ TTQKGQKNS   688
KGE60162            ------------------------------------------------------------------- ---------
KGE60856            ------------------------------------------------------------------- ---------
WP_002989955   703  TFKEDIQKAQVSG-QGDS-LHEHIANLAGSPAIKKGILQTVKVVDELVKVMGrHKPENIVIEMARENQ TTQKGQKNS   777
WP_003030002   704  SFKEEIARAQIIG-DVDD-IANVVHDLPGSPAIKKGILQSVKIVDELVKVMG-HNPANIIIEMARENQ MTDKGRRNS   777
WP_003065552   707  PFKQIIQKSQVVG-DVDD-IEAVVHDLPGSPAIKKGILQSVKIVDELVKVMG-DNPDNIVIEMARENQ TTNRGRSQS   780
WP_001040076   702  SFKPIIDKARTGS-HSDN-LKEVIGELAGSPAIKKGILQSLKIVDELVKVMG-YEPEQIVVEMARENQ TTAKGLSRS   775
WP_001040078   705  SFKSIISKAQAGS-HSDN-LKEVVGELAGSPAIKKGILQSLKIVDELVKVMG-YEPEQIVVEMARENQ TTNQGRRNS   778
WP_001040080   705  SFKSIISKAQAGS-HSDN-LKEVVGELAGSPAIKKGILQSLKIVDELVKVMG-YEPEQIVVEMARENQ TTNQGRRNS   778
WP_001040081   705  SFKSIISKAQAGS-HSDN-LKEVVGELAGSPAIKKGILQSLKIVDELVKVMG-YEPEQIVVEMARENQ TTNQGRRNS   778
WP_001040083   705  SFKSIISKAQAGS-HSDN-LKEVVGELAGSPAIKKGILQSLKIVDELVKVMG-YEPEQIVVEMARENQ TTNQGRRNS   778
WP_001040085   705  SFKSIISKAQAGS-HSDN-LKEVVGELAGSPAIKKGILQSLKIVDELVKVMG-YEPEQIVVEMARENQ TTNQGRRNS   778
WP_001040087   705  SFKSIISKAQAGS-HSDN-LKEVVGELAGSPAIKKGILQSLKIVDELVKVMG-YEPEQIVVEMARENQ TTNQGRRNS   778
WP_001040088   705  SEKSIISKAQAGS-HSDN-LKEVVGELAGSPAIKKGILQSLKIVDELVKVMG-YEPEQIVVEMARENQ TTNQGRRNS   778
WP_001040089   705  SEKSIISKAQAGS-HSDN-LKEVVGELAGSPAIKKGILQSLKIVDELVKVMG-YEPEQIVVEMARENQ TTNQGRRNS   778
WP_001040090   705  SFKSIISKAQAGS-HSDN-LKEVVGELAGSPAIKKGILQSLKIVDELVKVVG-YEPEQIVVEMARENQ TTNQGRRNS   778
WP_001040091   705  SFKSIISKAQAGS-HSDN-LKEVVGELAGSPAIKKGILQSLKIVDELVKVMG-YEPEQIVVEMARENQ TTNQGRRNS   778
WP_001040092   705  SFKSIISKAQSGS-HSDN-LKEVVGELAGSPAIKKGILQSLKIVDELVKVMG-YEPEQIVVEMARENQ TTNQGRRNS   778
WP_001040094   702  SFKPIIDKARTGS-HSDN-LKEVVGELAGSPAIKKGILQSLKIVDELVKVMG-YEPEQIVVEMARENQ TTAKGLSRS   775
WP_001040095   702  SFKPIIDKARTGS-HLDN-LKEVVGELAGSPAIKKGILQSLKIVDELVKVMG-YEPEQIVVEMARENQ TTAKGLSRS   775
WP_001040096   702  SFKPIIDKARTGS-HLDN-LKEVVGELAGSPAIKKGILQSLKIVDELVKVMG-YEPEQIVVEMARENQ TTAKGLSRS   775
WP_001040097   702  SFKPIIDKARTGS-HSDN-LKEVVGELAGSPAIKKGILQSLKIVDELVKVMG-YEPEQIVVEMARENQ TTAKGLSRL   775
WP_001040098   702  SFKPIIDKARTGS-HSDN-LKEVVGELAGSPAIKKGILQSLKIVDELVKVMG-YEPEQIVVEMARENQ TTAKGLSRS   775
WP_001040099   702  SFKPIIDKARTGS-HSDN-LKEVVGELAGSPAIKKGILQSLKIVDELVKVMG-YEPEQIVVEMARENQ TTAKGLSRS   775
WP_001040100   702  SFKPIIDKARTGS-HSDN-LKEVVGELAGSPAIKKGILQSLKIVDELVKVMG-YEPEQIVVEMARENQ TTAKGLSRS   775
WP_001040104   705  SFKSIISKAQAGS-HSDN-LKEVVGELAGSPAIKKGILQSLKIVDELVKVMG-YEPEQIVVEMARENQ TTNQGRRNS   778
WP_001040105   705  SFKSIISKAQAGS-HSDN-LKEVVGELAGSPAIKKGILQSLKIVDELVKVMG-YEPEQIVVEMARENQ TTNQGRRNS   778
WP_001040106   705  SFKPIIDKAQAGS-HSDN-LKEVVGELAGSPAIKKGILQSLKIVDELVKVMG-YEPEQVVVEMARENQ TTNQGRRNT   778
WP_001040107   705  SFKPIIDKAQAGS-HSDN-LKEVVGELAGSPAIKKGILQSLKIVDELVKVMG-YEPEQVVVEMARENQ TTNQGRRNT   778
```

-continued

```
WP_001040108   705 SFKPIIDKAQAGS-HSDN-LKEVVGELAGSPAIKKGILQSLKIVDELVKVMG-YEPEQVVVEMARENQ TTNQGRRNT   778
WP_001040109   705 SFKPIIDKAQAGS-HSDN-LKEVVGELAGSPAIKKGILQSLKIVDELVKVMG-YEPEQVVVEMARENQ TTNQGRRNT   778
WP_001040110   705 SFKPIIDKAQAGS-HSDN-LKEVVGELAGSPAIKKGILQSLKIVDELVKVMG-YEPEQVVVEMARENQ TTNQGRRNT   778
WP_015058523   705 SFKSIISKAQSGS-HSDN-LKEVVGELAGSPAIKKGILQSLKIVDELVKVMG-YEPEQIVVEMARENQ TTNQGRRNS   778
WP_017643650   702 SFKPIIDKARTGS-HSDN-LKEVVGELAGSPAIKKGILQSLKIVDELVKVMG-YEPEQIVVEMARENQ TTAKGLSRL   775
WP_017647151   705 SFKSIISKAQAGS-HSDN-LKEVVGELAGSPAIKKGILQSLKIVDELVKVMG-YEPEQIVVEMARENQ TTNQGRRNS   778
WP_017648376   705 SFKSIISKAQAGS-HSDN-LKEVVGELAGSPAIKKGILQSLKIVDELVKVMG-YEPEQIVVEMARENQ TTNQGRRNS   778
WP_017649527   705 SFKSIISKAQAGS-HSDN-LKEVVGELAGSPAIKKGILQSLKIVDELVKVMG-YEPEQIVVEMARENQ TTNQGRRNS   778
WP_017771611   705 SFKPIIDKAQAGS-HSDN-LKEVVGELAGSPAIKKGILQSLKIVDELVKVMG-YEPEQVVVEMARENQ TTNQGRRNT   778
WP_017771984   705 SEKSIISKAQAGS-HSDN-LKEVVGELAGSPAIKKGILQSLKIVDELVKVMG-YEPEQIVVEMARENQ TTNQGRRNS   778
CFQ25032       705 SFKSIISKAQAGS-HSDN-LKEVVGELAGSPAIKKGILQSLKIVDELVKVMG-YEPEQIVVEMARENQ TTNQGRRNS   778
CFV16040       705 SFKSIISKAQAGS-HSDN-LKEVVGELAGSPAIKKGILQSLKIVDELVKVMG-YEPEQIVVEMARENQ TTNQGRRNS   778
KLJ37842       705 SFKSIISKAQAGS-HSDN-LKEVVGELAGSPAIKKGILQSLKIVDELVKVMG-YEPEQIVVEMARENQ TTNQGRRNS   778
KLJ72361       705 SFKSIISKAQAGS-HSDN-LKEVVGELAGSPAIKKGILQSLKIVDELVKVMG-YEPEQIVVEMARENQ TTNQGRRNS   778
KLL20707       719 SFKSIISKAQAGS-HSDN-LKEVVGELAGSPAIKKGILQSLKIVDELVKVMG-YEPEQIVVEMARENQ TTNQGRRNS   792
KLL42645       705 SFKPIIDKAQAGS-HSDN-LKEVVGELAGSPAIKKGILQSLKIVDELVKVMG-YEPEQVVVEMARENQ TTNKGRRNT   778
WP_047207273   705 SFKSIISKAQAGS-HSDN-LKEVVGELAGSPAIKKGILQSLKIVDELVKVMG-YEPEQIVVEMARENQ TTNQGRRNS   778
WP_047209694   702 SFKPIIDKARTGS-HSDN-LKEVVGELAGSPAIKKGILQSLKIVDELVKVMG-YEPEQIVVEMARENQ TTAKGLSRS   775
WP_050198062   705 SFKSIISKAQAGS-HSDN-LKEVVGELAGSPAIKKGILQSLKIVDELVKVMG-YEPEQIVVEMARENQ TTNQGRRNS   778
WP_050201642   705 SFKSIISKAQAGS-HSDN-LKEVVGELAGSPAIKKGILQSLKIVDELVKVMG-YEPEQIVVEMARENQ TTNQGRRNS   778
WP_050204027   705 SFKPIIDKAQAGS-HSDN-LKEVVGELAGSPAIKKGILQSLKIVDELVKVMG-YEPEQVVVEMARENQ TTNQGRRNT   778
WP_050881965   705 SEKSIISKAQAGS-HSDN-LKEVVGELAGSPAIKKGILQSLKIVDELVKVMG-YEPEQIVVEMARENQ TTNQGRRNS   778
WP_050886065   705 SFKSIISKAQAGS-HSDN-LKEVVGELAGSPAIKKGILQSLKIVDELVKVMG-YEPEQIVVEMARENQ TTNQGRRNS   778
AHN30376       705 SFKSIISKAQSGS-HSDN-LKEVVGELAGSPAIKKGILQSLKIVDELVKVMG-YEPEQIVVEMARENQ TTNQGRRNS   778
EAO78426       705 SFKSIISKAQAGS-HSDN-LKEVVGELAGSPAIKKGILQSLKIVDELVKVMG-YEPEQIVVEMARENQ TTNQGRRNS   778
CCW42055       705 SFKSIISKAQSGS-HSDN-LKEVVSELAGSPAIKKGILQSLKIVDELVKVMG-YKPEQIVVEMARENQ TTNQGRRNS   778
WP_003041502   704 SFKEEIAKAQIIG-DVDD-IANVVHDLPGSPAIKKGILQSVKIVDELVKVMG-HNPANIIIEMARENQ TTDRGRRNS   777
WP_037593752   705 SFKEEIARAQIIG-DVDD-IANVVHDLPGSPAIKKGILQSVKIVDELVKVMG-HNPANIIIEMARENQ TTDKGRRNS   778
WP_049516684   705 SFKEEIARAQIIG-DVDD-IANVVHDLPGSPAIKKGILQSVKIVDELVKVMG-HNPANIIIEMARENQ TTDKGRRNS   778
GAD46167       704 SFKEEIARAQIIG-DVDD-IANVVHDLPGSPAIKKGILQSVKIVDELVKVMG-HNPANIIIEMARENQ TTDKGRRNS   777
WP_018363470   705 SFKQIIQEAQVVG-DVDD-IETVVHDLPGSPAIKKGILQSVKIVDELIKVMG-DNPDNIVIEMARENQ TTNRGRSQS   778
WP_003043819   713 TFKEEIEKAQVSG-QGDS-LHEQIADLAGSPAIKKGILQTVKIVDELVKVMG-HKPENIVIEMARENQ TTTKGLQQS   786
WP_006269658   704 SFKEEIARAQIID-DVDD-IANVVHDLPGSPAIKKGILQSVKIVDELVKVMG-HNPANIIIEMARENQ TTDKGRRNS   777
WP_048800889   704 PFKQIIKDAQAID-DVDD-IELIVHDLPGSPAIKKGILQSIKIVDELVKVMG-YNPDNIVIEMARENQ TTTKGRRNS   777
WP_012767106   703 TFKEAIQKAQVSG-QGHS-LHEQIANLAGSPAIKKGILQSVKVVDELVKVMG-HKPENIVIEMARENQ TTQKGQKNS   776
WP_014612333   703 TFKEAIQKAQVSG-QGHS-LHEQIANLAGSPAIKKGILQSVKVVDELVKVMG-HKPENIVIEMARENQ TTQKGQKNS   776
WP_015017095   703 TFKEAIQKAQVSG-QGHS-LHEQIANLAGSPAIKKGILQSVKVVDELVKVMG-HKPENIVIEMARENQ TTQKGQKNS   776
WP_015057649   703 TFKEAIQKAQVSG-QGHS-LHEQIANLAGSPAIKKGILQSVKVVDELVKVMG-HKPENIVIEMARENQ TTQKGQKNS   776
WP_048327215   703 TFKEAIQKAQVSG-QGHS-LHEQIANLAGSPAIKKGILQSVKVVDELVKVMG-HKPENIVIEMARENQ TTQKGQKNS   776
WP_049519324   703 TFKEAIQKAQVSG-QGHS-LHEQIANLAGSPAIKKGILQSVKVVDELVKVMG-HKPENIVIEMARENQ TTQKGQKNS   776
```

-continued

```
WP_012515931  703 SFIDEIAKAQVIG-KTEY-SKDLVGNLAGSPAIKKGISQTIKIVDELVKIMG-YLPQQIVIEMARENQ TTAQGIKNA  776
WP_021320964  703 SFIDEIAKAQVIG-KTEY-SKDLVGNLASSPAIKKGISQTIKIVDELVKIMG-YLPQQIVIEMARENQ TTAQGIKNA  776
WP_037581760  703 SFIDEIAKAQVIG-KTEY-SKDLVGNLAGSPAIKKGISQTIKIVDELVKIMG-YLPQQIVIEMARENQ TTAQGIKNA  776
WP_004232481  704 SFKTTIQEAQVVG-DVDD-IEAVVHDLPGSPAIKKGILQSVKIVDELVKVMG-HNPQNIVIEMARENQ ITGYGRNRS  777
WP_009854540  705 PFKQIIQKSQVVG-DVDD-IEAVVHDLPGSPAIKKGILQSVKIVDELVKVMG-DNPDNIVIEMARENQ TTNRGRSQS  778
WP_012962174  705 PFKQIIKDAQIIG-DIDD-VTSVVRELPGSPAIKKGILQSVKIVDELVKVMG-HNPDNIVIEMARENQ TTNRGRNQS  778
WP_039695303  707 PFKQIIQKSQVVG-DVDD-IEAVVHDLPGSPAIKKGILQSVKIVDELVKVMG-GNPDNIVIEMARENQ TTNRGRSQS  780
WP_014334983  704 SFKTIIQEAQVVG-DVDD-IEAVVHDLPGSPAIKKGILQSVKIVDELVKVMG-DNPDNIVIEMARENQ TTGYGRNKS  777
WP_003099269  703 DFAKIIKNEQEKTiKNES-LEETIANLAGSPAIKKGILQSIKIVDEIVKIMG-QNPDNIVIEMARENQ STMQGIKNS  777
AHY15608      703 DFAKIIKNEQEKTiKNES-LEETIANLAGSPAIKKGILQSIKIVDEIVKIMG-QNPDNIVIEMARENQ STMQGIKNS  777
AHY17476      703 DFAKIIKNEQEKTiKNES-LEETIANLAGSPAIKKGILQSIKIVDEIVKIMG-QNPDNIVIEMARENQ STMQGIKNS  777
ESR09100          ----------------------------------------------------------------- ---------
AGM98575      703 DFAKIIKNEQEKTIKNES-LEETIANLAGSPAIKKGILQSIKIVDEIVKIMG-QNPDNIVIEMARENQ STMQGIKNS  777
ALF27331      704 SFKEEIAKAQVIG-ETDN-LNQVVSDIAGSPAIKKGILQSLKIVDELVKIMG-HQPENIVVEMARENQ FTNQGRRNS  777
WP_018372492  717 DFKEIIRKAQTIE-NIDT-NQALVSSLPGSPAIKKGILQSLNIVDEIIAIMG-YAPTNIVIEMARENQ TTQKGRDNS  790
WP_045618028  703 SFKEIIQKAQVVG-KIND-VKQVVQELPGSPAIKKGILQSIKLVDELVKVMG-HAPESIVIEMARENQ TTARGKKNS  776
WP_045635197  702 SFKEIIQKAQVIG-KTDD-VKQVVQELSGSPAIKKGILQSIKIVDELVKVMG-HAPESIVIEMARENQ TTARGKKNS  775
WP_002263549  704 SFKEEIAKAQVIG-ETDN-LNQVVSDIAGSPAIKKGILQSLKIVDELVKIMG-HQPENIVVEMARENQ FTNQGRRNS  777
WP_002263887  704 SFKEEIAKAQVIG-ETDN-LNQVVSDIAGSPAIKKGILQSLKIVDELVKIMG-HQPENIVVEMARENQ FTNQGRRNS  777
WP_002264920  704 SFKEEIAKAQVIG-ETDN-LNQVVSDIAGSPAIKKGILQSLKIVDELVKIMG-HQPENIVVEMARENQ FTNQGRRNS  777
WP_002269043  704 SFKEEIAKAQVIG-ETDN-LNQVVSDIAGSPAIKKGILQSLKIVDELVKIMG-HQPENIVVEMARENQ FTNQGRRNS  777
WP_002269448  704 SFKEEIAKAQVIG-ETDN-LNQVVSDIAGSPAIKKGILQSLKIVDELVKIMG-HQPENIVVEMARENQ FTNQGRQNS  777
WP_002271977  704 SFKEEIAKAQVIG-ETDN-LNQVVSDIAGSPAIKKGILQSLKIVDELVKIMG-HQPENIVVEMARENQ FTNQGRRNS  777
WP_002272766  704 SFKEEIAKAQVIG-ETDN-LNQVVSDIAGSPAIKKGILQSLKIVDELVKIMG-HQPENIVVEMARENQ FTNQGRRNS  777
WP_002273241  704 SFKEEIAKAQVIG-ETDN-LNQVVSDIAGSPAIKKGILQSLKIVDELVKIMG-HQPENIVVEMARENQ FTKQGRRNS  777
WP_002275430  704 SFKEEIAKAQVIG-ETDN-LNQVVSDIAGSPAIKKGILQSLKIVDELVKIMG-HQPENIVVEMARENQ FTNQGRRNS  777
WP_002276448  704 SFKEEIAKAQVIG-ETDN-LNQVVSDIAGSPAIKKGILQSLKIVDELVKIMG-HQPENIVVEMARENQ FTKQGRRNS  777
WP_002277050  705 TFKDDIVKAQYVD-NSDD-LHQVVQSLAGSPAIKKGILQSLKIVDELVKVMG-KEPEQIVVEMARENQ TTAKGRRNS  778
WP_002277364  704 SFKEEIAKAQVIG-ETDN-LNQVVSDIAGSPAIKKGILQSLKIVDELVKIMG-HQPENIVVEMARENQ FTNQGRRNS  777
WP_002279025  704 SFKEEIAKAQVIG-ETDN-LNQVVSDIAGSPAIKKGILQSLKIVDELVKIMG-HQPENIVVEMARENQ FTNQGRRNS  777
WP_002279859  704 SFKEEIAKAQVIG-ETDN-LNQVVSDIAGSPAIKKGILQSLKIVDELVKIMG-HQPENIVVEMARENQ FTNQGRRNS  777
WP_002280230  704 SFKEEIAKAQVIG-ETDN-LNQVVSDIAGSPAIKKGILQSLKIVDELVKIMG-HQPENIVVEMARENQ FTKQGRRNS  777
WP_002281696  704 SFKEEIAKAQVIG-ETDN-LNQVVSDIAGSPAIKKGILQSLKIVDELVKIMG-HQPENIVVEMARENQ FTNQGRRNS  777
WP_002282247  705 TFKDDIVKAQYVD-NSDD-LHQVVQSLAGSPAIKKGILQSLKIVDELVKVMG-KEPEQIVVEMARENQ TTAKGRRNS  778
WP_002282906  704 SFKEEIAKAQVIG-ETDN-LNQVVSDIAGSPAIKKGILQSLKIVDELVKIMG-HQPENIVVEMARENQ FTNQGRRNS  777
WP_002283846  704 SFKEEIAKAQVIG-ETDN-LNQVVSDIAGSPAIKKGILQSLKIVDELVKIMG-HQPENIVVEMARENQ FTNQGRRNS  777
WP_002287255  704 SFKEEIAKAQVIG-ETDN-LNQVVSDIAGSPAIKKGILQSLKIVDELVKIMG-HQPENIVVEMARENQ FTNQGRRNS  777
WP_002288990  704 SFKEEIAKAQVIG-ETDN-LNQVVSDIAGSPAIKKGILQSLKIVDELVKIMG-HQPENIVVEMARENQ FTNQGRRNS  777
WP_002289641  704 SFKEEIAKAQVIG-ETDN-LNQVVSDIAGSPAIKKGILQSLKIVDELVKIMG-HQPENIVVEMARENQ FTNQGRRNS  777
WP_002290427  704 SFKEEIAKAQVIG-ETDN-LNQVVSDIAGSLAIKKGILQSLKIVDELVKIMG-HQPENIVVEMARENQ FTNQGRRNS  777
WP_002295753  704 SFKEEIAKAQVIG-ETDN-LNQVVSDIAGSPAIKKGILQSLKIVDELVKIMG-HQPENIVVEMARENQ FTKQGRRNS  777
```

-continued

```
WP_002296423   704 SFKEEIAKAQVIG-ETDN-LNQVVSDIAGSPAIKKGILQSLKIVDELVKIMG-HQPENIVVEMARENQ FTNQGRRNS   777
WP_002304487   714 SFKEEIAKAQVIG-EMDG-LNQVVSDIAGSPAIKKGILQSLKIVDELVKVMG-HNPANIVIEMARENQ TTAKGRRSS   787
WP_002305844   704 SFKEEIAKAQVIG-ETDN-LNQVVSDIAGSPAIKKGILQSLKIVDELVKIMG-HQPENIVVEMARENQ FTKQGRRNS   777
WP_002307203   704 SFKEEIAKAQVIG-ETDN-LNQVVSDIAGSPAIKKGILQSLKIVDELVKIMG-HQPENIVVEMARENQ FTNQGRRNS   777
WP_002310390   704 SFKEEIAKAQVIG-ETDN-LNQVVSDIAGSLAIKKGILQSLKIVDELVKIMG-HQPENIVVEMARENQ FTNQGRRNS   777
WP_002352408   704 SFKEEIAKAQVIG-ETDN-LNQVVSDIAGSPAIKKGILQSLKIVDELVKIMG-HQPENIVVEMARENQ FTNQGQRNS   777
WP_012997688   704 SFKEEIAKAQVIG-ETDN-LNQVVSDIAGSPAIKKGILQSLKIVDELVKIMG-HQPENIVVEMARENQ FTNQGRRNS   777
WP_014677909   704 SFKEEIAKAQVIG-ETDN-LNQVVSDIAGSPAIKKGILQSLKIVDELVKIMG-HQPENIVVEMARENQ FTNQGRRNS   777
WP_019312892   704 SFKEEIAKAQVIG-ETDN-LNQVVSDIAGSPAIKKGILQSLKIVDELVKIMG-HQPENIVVEMARENQ FTNQGRRNS   777
WP_019313659   704 SFKEEIAKAQVIG-ETDN-LNQVVSDIAGSPAIKKGILQSLKIVDELVKIMG-HQPENIVVEMARENQ FTNQGRRNS   777
WP_019314093   704 SFKEEIAKAQVIG-ETDN-LNQVVSDIAGSPAIKKGILQSLKIVDELVKIMG-HQPENIVVEMARENQ FTNQGRRNS   777
WP_019315370   704 SFKEEIAKAQVIG-ETDN-LNQVVSDIAGSPAIKKGILQSLKIVDELVKIMG-HQPENIVVEMARENQ FTNQGRRNS   777
WP_019803776   704 SFKEEIAKAQVIG-ETDN-LNQVVSDIAGSPAIKKGILQSLKIVDELVKIMG-HQPENIVVEMARENQ FTNQGRRNS   777
WP_019805234   704 SFKEEIAKAQVIG-ETDN-LNQVVSDIAGSLAIKKGILQNLKIVDELVKIMG-HQPENIVVEMARENQ FTNQGRRNS   777
WP_024783594   704 SFKEEIAKAQVIG-ETDN-LNQVVSDIAGSPAIKKGILQSLKIVDELVKIMG-HQPENIVVEMARENQ FTNQGRRNS   777
WP_024784288   705 TFKDDIVKAQYVD-NSDD-LHQVVQSLAGSPAIKKGILQSLKIVDELVKVMG-KEPEQIVVEMARENQ TTAKGRRNS   778
WP_024784666   704 SFKEEIAKAQVIG-ETDN-LNQVVSDIAGSPAIKKGILQSLKIVDELVKIMG-HQPENIVVEMARENQ FTNQGRRNS   777
WP_024784894   704 SFKEEIAKAQVIG-ETDN-LNQVVSDIAGSPAIKKGILQSLKIVDELVKIMG-HQPENIVVEMARENQ FTNQGRRNS   777
WP_024786433   705 TFKDDIVKAQYVD-NSDD-LHQVVQSLAGSPAIKKGILQSLKIVDELVKVMG-KEPEQIVVEMARENQ TTAKGRRNS   778
WP_049473442   704 SFKEEIAKAQVIG-ETDN-LNQVVSDIAGSPAIKKGILQSLKIVDELVKIMG-HQPENIVVEMARENQ FTNQGRRNS   777
WP_049474547   704 SFKEEIAKAQVIG-ETDN-LNQVVSDIAGSPAIKKGILQSLKIVDELVKIMG-HQPENIVVEMARENQ FTNQGRRNS   777
EMC03581       697 SFKEEIAKAQVIG-ETDN-LNQVVSDIAGSPAIKKGILQSLKIVDELVKIMG-HQPENIVVEMARENQ FTNQGRRNS   770
WP_000428612   705 SFKEIIKKAQVVG-KTDD-VKQVVQELPGSPAIKKGILQSIKLVDELVKVMG-HEPESIVIEMARENQ TTARGKKNS   778
WP_000428613   703 SFKEITQKAQVVG-KTDD-VKQVVQELPGSPAIKKGILQSIKLVDELVKVMG-HTPESIVIEMARENQ TTARGKKNS   776
WP_049523028   702 SFKETIQKAQVVG-ETND-VKQVVQELPGSPAIKKGILQSIKIVDELVKVMG-HAPESVVIEMARENQ TTNKGKSKS   775
WP_003107102   672 DFASIIKEAQEKTiKSEK-LEETIANLAGSPAIKKGILQSVKIVDEVVKVMG-YEPSNIVIEMARENQ STQRGINNS   746
WP_054279288   705 SFKEEIKKAQEGG-LKDS-INDQIRDLAGSPAIKKGILQTINIVDEIVKIMG-KAPQHIVVEMARDVQ KTDIGVKQS   778
WP_049531101   703 SFKEIIQESQVVG-KPDD-VKQIVQELPGSSAIKKGILQSIKLVDELVKVMG-HDPESIVIEMARENQ TTARGKKNS   776
WP_049538452   703 SFKEIIQKAQVFG-KIND-VKQVVQELPGSPAIKKGILQSIKIVEELVKVMG-HEPESIVIEMARENQ TTTRGKKNS   776
WP_049549711   703 SFKKIIQKSQVVG-ETDD-VKQVVRELPGSPAIKKGILQSIKIVDELVKVMD-HAPESIVIEMARENQ TTARGKKNS   776
WP_007896501   706 DFEKLIDDAQKKAiKRES-LTEAVANLAGSPAIKKGILQSLKVVDEIVKVMG-HNPDNIVIEMSRENQ TTAQGLKNA   780
EFR44625       658 DFEKLIDDAQKKAIKRES-LTEAVANLAGSPAIKKGILQSLKVVDEIVKVMG-HNPDNIVIEMSRENQ TTAQGLKNA   732
WP_002897477   702 SFKEIIQKAQVVG-KTDD-VKQVVQELPGSPAIKKGILQSIKIVDELVKVMG-YALESIVIEMARENQ TTARGKKNS   775
WP_002906454   702 SFKEIIQKAQVVG-KTDD-VKQVVQEIPGSPAIKKGILQSIKIVDELVKVMG-HNPESIVIEMARENQ TTAKGKKNS   775
WP_009729476   703 SFKEIIQKAQVVG-KIND-VKQVVQELPGSPAIKKGILQSIKIVDELVKVMG-HAPESIVIEMARENQ TTARGKKNS   776
CQR24647       706 SFKDEIANSQVIG-DGDD-LHQVVQELAGSPAIKKGILQSLKIVDELVKVMG-YNPEQIVVEMARENQ TTARGRNNS   779
WP_000066813   705 SFKEIIQKAQVFG-KIND-VKQVVQELPGSPAIKKGILQSIKIVDELVKVMG-HAPESIVIEMARENQ TTARGKKNS   778
WP_009754323   703 SFKEIIQKAQVVG-KTDD-LTQVVRELSGSPAIKKGILQSIKIVDELVKIMG-YAPESIVIEMARENQ TTAKGKKNS   776
WP_044674937   702 SFVDEIRLAQGSG-EAED-YRAEVQNLAGSPAIKKGILQSLKIVDELIEVMG-YDPEHIVVEMARENQ FTNQGRRNS   775
WP_044676715   704 SFVDEIRLAQGSG-EAED-YRAEVQNLAGSPAIKKGILQSLKIVDELIEVMG-YDPEHIVVEMARENQ FTNQGRRNS   777
```

-continued

| | | | |
|---|---|---|---|
| WP_044680361 | 704 | SFVDEIRLAQGSG-EAED-YRAEVQNLAGSPAIKKGILQSLKIVDELIEVMG-YDPEHIVVEMARENQ FTNQGRRNS | 777 |
| WP_044681799 | 702 | SFVDEIRLAQGSG-EAED-YRAEVQNLAGSPAIKKGILQSLKIVDELIEVMG-YDPEHIVVEMARENQ FTNQGRRNS | 775 |
| WP_049533112 | 704 | SFKEEIAKAQVIG-ETDD-LNQVVSDIAGSPAIKKGILQSLKIVDELVKVMG-YNPANIVIEMARENQ TTDKGRRNS | 777 |
| WP_029090905 | 683 | LFKKIIEEQFENEtALLN--KQRIDELAASPANKKGIWQAIKIVKELEKVLQ-QPAENIFIEFARSDE ES----KRS | 752 |
| WP_006506696 | 706 | GYAQMIEEATSCPeDGKF-TYEEVERLAGSPALKRGIWQSLQIVEEITKVMK-CRPKYIYIEFERSEE -----KERT | 776 |
| AIT42264 | 703 | TFKEDIQKAQVSG-QGDS-LHEHIANLAGSPAIKKGILQTVKVVDELVKVMGrHKPENIVIEMARENQ TTQKGQKNS | 777 |
| WP_034440723 | 711 | SFKEKIRKAQDIN-QVND-IKEIVKDLPGSPAIKKGIYQSIRIVDEIIRKMK-DRPKNIVIEMARENQ TTQEGKNKS | 784 |
| AKQ21048 | 703 | TFKEDIQKAQVSG-QGDS-LHEHIANLAGSPAIKKGILQTVKVVDELVKVMGrHKPENIVIEMARENQ TTQKGQKNS | 777 |
| WP_004636532 | 707 | SFKKKIEDAQTIE-DTTH-IYDTVAELPGSPAIKKGIRQALKIVEEIIDIIG-YEPENIVVEMARESQ TTKKGKDLS | 780 |
| WP_002364836 | 715 | SFKNAIQKAQSSE-HEET-LSETVNELAGSPAIKKGIYQSLKIVDELVAIMG-YAPKRIVVEMARENQ TTSTGKRRS | 788 |
| WP_016631044 | 666 | SFKNAIQKAQSSE-HEET-LSETVNELAGSPAIKKGIYQSLKIVDELVAIMG-YAPKRIVVEMARENQ TTSTGKRRS | 739 |
| EMS75795 | 455 | SFKEELANELALA-GNQS-LLEVVEALLGSPAIKKGIWQTLKIVEELIEIIG-YNPKNIVVEMARENQ RT----NRS | 524 |
| WP_002373311 | 715 | SFKNAIQKAQSSE-HEET-LSETVNELAGSPAIKKGIYQSLKIVDELVAIMG-YAPKRIVVEMARENQ TTSTGKRRS | 788 |
| WP_002378009 | 715 | SFKNAIQKAQSSE-HEET-LSETVNELAGSPAIKKGIYQSLKIVDELVAIMG-YAPKRIVVEMARENQ TTSTGKRRS | 788 |
| WP_002407324 | 715 | SFKNAIQKAQSSE-HEET-LSETVNELAGSPAIKKGIYQSLKIVDELVAIMG-YAPKRIVVEMARENQ TTSTGKRRS | 788 |
| WP_002413717 | 715 | SFKNAIQKAQSSE-HEET-LSETVNELAGSPAIKKGIYQSLKIVDELVAIMG-YAPKRIVVEMARENQ TTSTGKRRS | 788 |
| WP_010775580 | 717 | SFKNAIQKAQSSE-HEET-LSETVNELAGSPAIKKGIYQSLKIVDELVAIMG-YAPKRIVVEMARENQ TTSTGKRRS | 790 |
| WP_010818269 | 715 | SFKNAIQKAQSSE-HEET-LSETVNELAGSPAIKKGIYQSLKIVDELVAIMG-YAPKRIVVEMARENQ TTSTGKRRS | 788 |
| WP_010824395 | 715 | SFKNAIQKAQSSE-HEET-LSETVNELAGSPAIKKGIYQSLKIVDELVAIMG-YAPKRIVVEMARENQ TTSTGKRRS | 788 |
| WP_016622645 | 715 | SFKNAIQKAQSSE-HEET-LSETVNELAGSPAIKKGIYQSLKIVDELVAIMG-YAPKRIVVEMARENQ TTSTGKRRS | 788 |
| WP_033624816 | 715 | SFKNAIQKAQSSE-HEET-LSETVNELAGSPAIKKGIYQSLKIVDELVAIMG-YAPKRIVVEMARENQ TTSTGKRRS | 788 |
| WP_033625576 | 715 | SFKNAIQKAQSSE-HEET-LSETVNELAGSPAIKKGIYQSLKIVDELVAIMG-YAPKRIVVEMARENQ TTSTGKRRS | 788 |
| WP_033789179 | 715 | SFKNAIQKAQSSE-HEET-LSETVNELAGSPAIKKGIYQSLKIVDELVAIMG-YAPKRIVVEMARENQ TTSTGKRRS | 788 |
| WP_002310644 | 715 | SFKKEIKKAQMIT-DTEN-LEEIVKELTGSPAIKKGILQSLKIVDEIVGIMG-YEPANIVVEMARENQ TTGRGLKSS | 788 |
| WP_002312694 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002314015 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002320716 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002330729 | 715 | SFKKEIKKAQMIT-DTEN-LEEIVKELTGSPAIKKGILQSLKIVDEIVGIMG-YEPANIVVEMARENQ TTGRGLKSS | 788 |
| WP_002335161 | 716 | SFKKEIKKAQMIT-DTEN-LEEIVKELTGSPAIKKGILQSLKIVDEIVGIMG-YEPANIVVEMARENQ TTGRGLKSS | 789 |
| WP_002345439 | 716 | SFKKEIKKAQMIT-DTEN-LEEIVKELTGSPAIKKGILQSLKIVDEIVGIMG-YEPANIVVEMARENQ TTGRGLKSS | 789 |
| WP_034867970 | 711 | SFKEEIAKATVFS-KHKS-LVDVIQDLPGSPAIKKGIWQSLKIVEELIAIIG-YKPKNIVIEMARENQ KT----HRT | 780 |
| WP_047937432 | 716 | SFKKEIKKAQMIT-DTEN-LEEIVKELTGSPAIKKGILQSLKIVDEIVGIMG-YEPANIVVEMARENQ TTGRGLKSS | 789 |
| WP_010720994 | 711 | SFKEEIAKATVFS-KHKS-LVDVIQDLPGSPAIKKGIWQSLKIVEELIAIIG-YKPKNIVIEMARENQ KT----HRT | 780 |
| WP_010737004 | 711 | SFKEEIAKATVFS-KHKS-LVDVIQDLPGSPAIKKGIWQSLKIVEELIAIIG-YKPKNIVIEMARENQ KT----HRT | 780 |
| WP_034700478 | 711 | SFKEEIAKATVFS-KHKS-LVDVIQDLPGSPAIKKGIWQSLKIVEELIAIIG-YKPKNIVIEMARENQ KT----HRT | 780 |
| WP_007209003 | 708 | SFKKIIEDSQPYK-EQQS-AEEIVSELSGSPAIKKGILQSLKIVDELVAIMG-YKPKNIVVEMARENQ TTGRGKQNS | 781 |
| WP_023519017 | 705 | SFKETIANELIMS-DSNV-LLDQVKAIPGSPAVKKGIWQSIKIVEEIIGIIG-KAPKNIVIEMARENQ RTSR----S | 774 |
| WP_010770040 | 708 | SFKSEIAEAQSDM-NTED-LHEVVQNLAGSPAIKKGILQSLKIVDELVDIMG-SLPKNIVVEMARENQ TTSRGRINS | 781 |
| WP_048604708 | 704 | TFKEEIEKEQLKA-NSEESLIEIVQNLAGSPAIKKGIFQSLKIVDELVEIMG-YAPTNIVVEMARENQ TTANGRRNS | 778 |
| WP_010750235 | 710 | SFKEEIAKELTLS-DKQS-LLEVVEAIPGSPAIKKGIWQTLKIVEELIAIIG-YKPKNIVVEMARENQ TTTGGKNRS | 783 |
| AII16583 | 742 | TFKEDIQKAQVSG-QGDS-LHEHIANLAGSPAIKKGILQTVKVVDELVKVMGrHKPENIVIEMARENQ TTQKGQKNS | 816 |

-continued

```
WP_029073316   718  GFKKTIDDANSTSVSGKF-SYAEVQELAGSPAIKRGIWQALLIVDEIKKIMK-HEPAHVYIEFARNED -----KERK   788
WP_031589969   718  GFKKTIDDANSTSVSGKF-SYAEVQELAGSPAIKRGIWQALLIVDEIKKIMK-HEPAHVYIEFARNED -----KERK   788
KDA45870       699  SFKETIKNAQVIE-KEET-LAKTVQELPGSPAIKKGILQSLEIVDEIIKVMG-YKPKSIVVEMARETQ --THGTRKR   771
WP_039099354   713  DEDKLITEANQMM-LAENdVQDVINDLYTSPQNKKALRQILLVVNDIQKAMKgQAPERILIEFAREDE VNPRLSVQR   788
AKP02966       707  DFKNYIENHNLNKNEDQN-ISNLVNDIHVSPALKRGITQSIKIVQEIVKFMG-HAPKYIFIEVTRETK TTSRGKRIQ   785
WP_010991369   707  SFKSIIEKEQVTT-ADKD-IQSIVADLAGSPAIKKGILQSLKIVDELVSVMG-YPPQTIVVEMARENQ TTGKGKNNS   780
WP_033838504   707  SFKSIIEKEQVTT-ADKD-IQSIVADLAGSPAIKKGILQSLKIVDELVSVMG-YPPQTIVVEMARENQ TTGKGKNNS   780
EHN60060       710  SFKSIIEKEQVTT-ADKD-IQSIVADLAGSPAIKKGILQSLKIVDELVSVMG-YPPQTIVVEMARENQ TTGKGKNNS   783
EFR89594       476  SFKSIIEKEQVTT-ADKD-IQSIVADLAGSPAIKKGILQSLKIVDELVSVMG-YPPQTIVVEMARENQ TTGKGKNNS   549
WP_038409211   707  SFKSIIEKEQVST-ADKG-IQSIVAELAGSPAIKKGILQSLKIVDELVGIMG-YPPQTIVVEMARENQ TTGKGKNNS   780
EFR95520       326  SFKSIIEKEQVST-ADKG-IQSIVAELAGSPAIKKGILQSLKIVDELVGIMG-YPPQTIVVEMARENQ TTGKGKNNS   399
WP_003723650   707  SFKSIIEKEQVST-TDKD-LQSIVAELAGSPAIKKGILQSLKIVDELVSIMG-YPPQTIVVEMARENQ TTGKGKNNS   780
WP_003727705   707  SFKSIIEKEQVST-TDKD-LQSIVADLAGSPAIKKGILQSLKIVDELVSIMG-YPPQTIVVEMARENQ TTGKGKNNS   780
WP_003730785   707  SFKSIIEKEQVST-TDKD-LQSIVADLAGSPAIKKGILQSLKIVDELVSIMG-YPPQTIVVEMARENQ TTGKGKNNS   780
WP_003733029   707  SFKSIIEKEQVST-TDKD-LQSIVAELAGSPAIKKGILQSLKIVDELVSVMG-YPPQTIVVEMARENQ TTNKGKNNS   780
WP_003739838   707  SFKSIIEKEQVST-TDKD-LQSIVADLAGSPAIKKGILQSLKIVDELVSIMG-YPPQTIVVEMARENQ TTVKGKNNS   780
WP_014601172   707  SFKSIIEKEQVST-TDKD-LQSIVAELAGSPAIKKGILQSLKIVDELVSIMG-YPPQTIVVEMARENQ TTGKGKNNS   780
WP_023548323   707  SFKSIIEKEQVST-ADKD-LQSIVADLAGSPAIKKGILQSLKVVEELVSVMG-YPPQTIVVEMARENQ TTNKGKNNS   780
WP_031665337   707  SFKSIIEKEQVST-TDKD-LQSIVAELAGSPAIKKGILQSLKIVDELVSIMG-YPPQTIVVEMARENQ TTGKGKNNS   780
WP_031669209   707  SFKSIIEKEQVST-ADKD-LQSIVADLAGSPAIKKGILQSLKVVEELVSVMG-YPPQTIVVEMARENQ TTNKGKNNS   780
WP_033920898   707  SFKSIIEKEQVST-ADKD-LQSIVADLAGSPAIKKGILQSLKVVEELVSVMG-YPPQTIVVEMARENQ TTNKGKNNS   780
AKI42028       710  SFKSIIEKEQVST-TDKD-LQSIVADLAGSPAIKKGILQSLKIVDELVSIMG-YPPQTIVVEMARENQ TTGKGKNNS   783
AKI50529       710  SFKSIIEKEQVST-ADKD-LQSIVADLAGSPAIKKGILQSLKVVEELVSVMG-YPPQTIVVEMARENQ TTNKGKNNS   783
EFR83390       155  SFKSIIEKEQVST-TDKD-LQSIVADLAGSPAIKKGILQSLKIVDELVSIMG-YPPQTIVVEMARENQ TTVKGKNNS   228
WP_046323366   707  SFKSIIEKEQVST-ADKD-IQSIVADLAGSPAIKKGILQSLKIVDELVGIMG-YPPQTIVVEMARENQ TTGKGKNNS   780
AKE81011       719  TFKEDIQKAQVSG-QGDS-LHEHIANLAGSPAIKKGILQTVKVVDELVKVMGrHKPENIVIEMARENQ TTQKGQKNS   793
CUO82355       710  GYAQMIEEASSCPKDGKF-TYEEVAKLAGSPALKRGIWQSLQIVEEITKVMK-CRPKYIYIEFERSEE -----KERT   780
WP_033162887   713  GYKQIIEESNMQDIEGPF-KYDEVKKLAGSPAIKRGIWQALLVVREITKFMK-HEPSHIYIEFAREEQ -----KVRK   783
AGZ01981       736  TFKEDIQKAQVSG-QGDS-LHEHIANLAGSPAIKKGILQTVKVVDELVKVMGrHKPENIVIEMARENQ TTQKGQKNS   810
AKA60242       703  TFKEDIQKAQVSG-QGDS-LHEHIANLAGSPAIKKGILQTVKVVDELVKVMGrHKPENIVIEMARENQ TTQKGQKNS   777
AKS40380       703  TFKEDIQKAQVSG-QGDS-LHEHIANLAGSPAIKKGILQTVKVVDELVKVMGrHKPENIVIEMARENQ TTQKGQKNS   777
4UN5_B         707  TFKEDIQKAQVSG-QGDS-LHEHIANLAGSPAIKKGILQTVKVVDELVKVMGrHKPENIVIEMARENQ TTQKGQKNS   781
WP_010922251   778  RERMKRIEEGIK ELGS QILKEHP--VE---NTQLQNEKLYLYYLQNGRDMYVDQEL--D--INRLSDYDVDHI     841
WP_039695303   781  QQRLKKLQNSLK PSYI E----DK--VE---NSHLQNDQLFLYYIQNGKDMYTGDEL--D--IDHLSDYDIDHI     851
WP_045635197   776  QQRYKRIEDSLK ILAS NILKENP--TD---NNQLQNDRLFLYYLQNGKDMYTGEAL--D--INQLSSYDIDHI     843
5AXW_A         488  KDAQKMINEMQK QTNE EIIRTTGk--E---NAKYLIEKIKLHDMQEGKCLYSLEAIplEdlLNNPFNYEVDHI    561
WP_009880683   462  RERMKRIEEGIK ELGS DILKEYP--VE---NTQLQNEKLYLYYLQNGRDMYVDQEL--D--INRLSDYDVDHI     525
WP_010922251   778  RERMKRIEEGIK ELGS QILKEHP--VE---NTQLQNEKLYLYYLQNGRDMYVDQEL--D--INRLSDYDVDHI     841
WP_011054416   778  RERMKRIEEGIK ELGS DILKEYP--VE---NTQLQNEKLYLYYLQNGRDMYVDQEL--D--INRLSDYDVDHI     841
WP_011284745   778  RERMKRIEEGIK ELGS QILKEHP--VE---NTQLQNEKLYLYYLQNGRDMYVDQEL--D--INRLSDYDVDHI     841
```

-continued

| | | | |
|---|---|---|---|
| WP_011285506 | 778 | RERMKRIEEGIK ELGS QILKEHP--VE---NTQLQNEKLYLYYLQNGRDMYVDQEL--D--INRLSDYDVDHI | 841 |
| WP_011527619 | 778 | RERMKRIEEGIK ELGS QILKEHP--VE---NTQLQNEKLYLYYLQNGRDMYVDQEL--D--INRLSDYDVDHI | 841 |
| WP_012560673 | 778 | RERMKRIEEGIK ELGS DILKEYP--VE---TTQLQNEKLYLYYLQNGRDMYVDQEL--D--INRLSDYDVDHI | 841 |
| WP_014407541 | 777 | RERMKRIEEGIK ELGS QILKEHP--VE---NTQLQNEKLYLYYLQNGRDMYVDQEL--D--INRLSDYDVDHI | 840 |
| WP_020905136 | 778 | RERMKRIEEGIK ELGS QILKEHP--VE---NTQLQNEKLYLYYLQNGRDMYVDQEL--D--INRLSDYDVDHI | 841 |
| WP_023080005 | 777 | RERMKRIEEGIK ELGS QILKEHP--VE---NTQLQNEKLYLYYLQNGRDMYVDQEL--D--INRLSDYDVDHI | 840 |
| WP_023610282 | 777 | RERMKRIEEGIK ELGS QILKEHP--VE---NTQLQNEKLYLYYLQNGRDMYVDQEL--D--INRLSDYDVDHI | 840 |
| WP_030125963 | 778 | RERMKRIEEGIK ELGS DILKEYP--VE---NTQLQNEKLYLYYLQNGRDMYVDQEL--D--INRLSDYDVDHI | 841 |
| WP_030126706 | 778 | RERMKRIEEGIK ELGS DILKEYP--VE---NTQLQNEKLYLYYLQNGRDMYVDQEL--D--INRLSDYDVDHI | 841 |
| WP_031488318 | 778 | RERMKRIEEGIK ELGS DILKEYP--VE---NTQLQNEKLYLYYLQNGRDMYVDQEL--D--INRLSDYDVDHI | 841 |
| WP_032460140 | 778 | RERMKRIEEGIK ELGS DILKEYP--VE---NTQLQNEKLYLYYLQNGRDMYVDQEL--D--INRLSDYDVDHI | 841 |
| WP_032461047 | 778 | RERMKRIEEGIK ELGS DILKEYP--VE---NTQLQNEKLYLYYLQNGRDMYVDQEL--D--INRLSDYDVDHI | 841 |
| WP_032462016 | 778 | RERMKRIEEGIK ELGS QILKEHP--VE---NTQLQNEKLYLYYLQNGRDMYVDQEL--D--INRLSDYDVDHI | 841 |
| WP_032462936 | 778 | RERMKRIEEGIK ELGS DILKEYP--VE---NTQLQNEKLYLYYLQNGRDMYVDQEL--D--INRLSDYDVDHI | 841 |
| WP_032464890 | 778 | RERMKRIEEGIK ELGS QILKEHP--VE---NTQLQNEKLYLYYLQNGRDMYVDQEL--D--INRLSDYDVDHI | 841 |
| WP_033888930 | 603 | RERMKRIEEGIK ELGS QILKEHP--VE---NTQLQNEKLYLYYLQNGRDMYVDQEL--D--INRLSDYDVDHI | 666 |
| WP_038431314 | 778 | RERMKRIEEGIK ELGS DILKEYP--VE---NTQLQNEKLYLYYLQNGRDMYVDQEL--D--INRLSDYDVDHI | 841 |
| WP_038432938 | 777 | RERMKRIEEGIK ELGS QILKEHP--VE---NTQLQNEKLYLYYLQNGRDMYVDQEL--D--INRLSDYDVDHI | 840 |
| WP_038434062 | 778 | RERMKRIEEGIK ELGS DILKEYP--VE---NTQLQNEKLYLYYLQNGRDMYVDQEL--D--INRLSDYDVDHI | 841 |
| BAQ51233 | 689 | RERMKRIEEGIK ELGS QILKEHP--VE---NTQLQNEKLYLYYLQNGRDMYVDQEL--D--INRLSDYDVDHI | 752 |
| KGE60162 | 1 | ------------ ---- ----------------------------------QEL--D--INRLSGYDVDHI | 16 |
| KGE60856 | | ------------ ---- ----------------------------------------------------- | |
| WP_002989955 | 778 | RERMKRIEEGIK ELGS QILKEHP--VE---NTQLQNEKLYLYYLQNGRDMYVDQEL--D--INRLSDYDVDHI | 841 |
| WP_003030002 | 778 | QQRLKLLQDSLK PVNI K-----N--VE---NQQLQNDRLFLYYIQNGKDMYTGETL--D--INNLSQYDIDHI | 840 |
| WP_003065552 | 781 | QQRLKKLQNSLK PSYI E----DK--VE---NSHLQNDQLFLYYIQNGKDMYTGDEL--D--IDHLSDYDIDHI | 851 |
| WP_001040076 | 776 | RQRLTTLRESLA NLKS EKKPKYV--KDqveNHHLSDDRLFLYYLQNGKDMYTDDEL--D--IDNLSQYDIDHI | 846 |
| WP_001040078 | 779 | RQRYKLLDDGVK NLAS NILKEYP--TD---NQALQNERLFLYYLQNGRDMYTGEAL--D--IDNLSQYDIDHI | 846 |
| WP_001040080 | 779 | RQRYKLLDDGVK NLAS NILKEYP--TD---NQALQNERLFLYYLQNGRDMYTGEAL--D--IDNLSQYDIDHI | 846 |
| WP_001040081 | 779 | RQRYKLLDDGVK NLAS NILKEYP--TD---NQALQNERLFLYYLQNGRDMYTGEAL--D--IDNLSQYDIDHI | 846 |
| WP_001040083 | 779 | RQRYKLLDDGVK NLAS NILKEYP--TD---NQALQNERLFLYYLQNGRDMYTGEAL--D--IDNLSQYDIDHI | 846 |
| WP_001040085 | 779 | RQRYKLLDDGVK NLAS NILKEYP--TD---NQALQNERLFLYYLQNGRDMYTGEAL--D--IDDLSQYDIDHI | 846 |
| WP_001040087 | 779 | RQRYKLLDDGVK NLAS NILKEYP--TD---NQALQNERLFLYYLQNGRDMYTGEAL--D--IDNLSQYDIDHI | 846 |
| WP_001040088 | 779 | RQRYKLLDDGVK NLAS NILKEYP--TD---NQALQNERLFLYYLQNGRDMYTGEAL--D--IDNLSQYDIDHI | 846 |
| WP_001040089 | 779 | RQRYKLLDDGVK NLAS NILKEYP--TD---NQALQNERLFLYYLQNGRDMYTGEAL--D--IDNLSQYDIDHI | 846 |
| WP_001040090 | 779 | RQRYKLLDDGVK NLAS NILKEYP--TD---NQALQNERLFLYYLQNGRDMYTGEAL--D--IDNLSQYDIDHI | 846 |
| WP_001040091 | 779 | RQRYKLLDDGVK NLAS NILKEYP--TD---NQALQNERLFLYYLQNGRDMYTGEAL--D--IDNLSQYDIDHI | 846 |
| WP_001040092 | 779 | RQRYKLLEDGVK NLAS DILKEYP--TD---NQALQNERLFLYYLQNGRDMYTGEAL--D--IDNLSQYDIDHI | 846 |
| WP_001040094 | 776 | RQRLTTLRESLA NLKS EKKPKYV--KDqveNHHLSDDRLFLYYLQNGKDMYTDDEL--D--IDNLSQYDIDHI | 846 |
| WP_001040095 | 776 | RQRLTTLRESLA NLKS EKKPKYV--KDqveNHHLSDDRLFLYYLQNGKDMYTDDEL--D--IDNLSQYDIDHI | 846 |
| WP_001040096 | 776 | RQRLTTLRESLA NLKS EKKPKYV--KDqveNHHLSDDRLFLYYLQNGKDMYTDDEL--D--IDNLSQYDIDHI | 846 |

-continued

| | | | |
|---|---|---|---|
| WP_001040097 | 776 | RQRLTTLRESLA NLKS EKKPKYV--KDqveNHHLSDDRLFLYYLQNGKDMYTDDEL--D--IDNLSQYDIDHI | 846 |
| WP_001040098 | 776 | RQRLTTLRESLA NLKS EKKPKYV--KDqveNHHLSDDRLFLYYLQNGKDMYTDDEL--D--IDNLSQYDIDHI | 846 |
| WP_001040099 | 776 | RQRLTTLRESLA NLKS EKKPKYV--KDqveNHHLSDDRLFLYYLQNGKDMYTDDEL--D--IDNLSQYDIDHI | 846 |
| WP_001040100 | 776 | RQRLTTLRESLA NLKS EKKPKYV--KDqveNHHLSDDRLFLYYLQNGKDMYTDDEL--D--IDNLSQYDIDHI | 846 |
| WP_001040104 | 779 | RQRYKLLDDGVK NLAS NILKEYP--TD---NQALQNERLFLYYLQNGRDMYTGEAL--D--IDNLSQYDIDHI | 846 |
| WP_001040105 | 779 | RQRYKLLDDGVK NLAS NILKEYP--TD---NQALQNERLFLYYLQNGRDMYTGEAL--D--IDNLSQYDIDHI | 846 |
| WP_001040106 | 779 | RQRYKLLEEGVK NLAS NILKEYP--TD---NQALQNERLFLYYLQNGRDMYTGEAL--D--IDNLSQYDIDHI | 846 |
| WP_001040107 | 779 | RQRYKLLEEGVK NLAS NILKEYP--TD---NQALQNERLFLYYLQNGRDMYTGEAL--D--IDNLSQYDIDHI | 846 |
| WP_001040108 | 779 | RQRYKLLEEGVK NLAS NILKEYP--TD---NQALQNERLFLYYLQNGRDMYTGETL--D--IDNLSQYDIDHI | 846 |
| WP_001040109 | 779 | RQRYKLLEEGVK NLAS NILKEYP--TD---NQALQNERLFLYYLQNGRDMYTGEAL--D--IDNLSQYDIDHI | 846 |
| WP_001040110 | 779 | RQRYKLLEEGVK NLAS NILKEYP--TD---NQALQNERLFLYYLQNGRDMYTGEAL--D--IDNLSQYDIDHI | 846 |
| WP_015058523 | 779 | RQRYKLLEDGVK NLAS DILKEYP--TD---NQALQNERLFLYYLQNGRDMYTGEAL--D--IDNLSQYDIDHI | 846 |
| WP_017643650 | 776 | RQRLTTLRESLA NLKS EKKPKYV--KDqveNHHLSDDRLFLYYLQNGKDMYTDDEL--D--IDNLSQYDIDLI | 846 |
| WP_017647151 | 779 | RQRYKLLDDGVK NLAS NILKEYP--TD---NQALQNERLFLYYLQNGRDMYTGKAL--D--IDNLSQYDIDHI | 846 |
| WP_017648376 | 779 | RQRYKLLDDGVK NLAS NILKEYP--TD---NQALQNERLFLYYLQNGRDMYTGKAL--D--IDNLSQYDIDHI | 846 |
| WP_017649527 | 779 | RQRYKLLDDGVK NLAS NILKEYP--TD---NQALQNERLFLYYLQNGRDMYTGEAL--D--IDNLSQYDIDHI | 846 |
| WP_017771611 | 779 | RQRYKLLEEGVK NLAS NILKEYP--TD---NQALQNERLFLYYLQNGRDMYTGEAL--D--IDNLSQYDIDHI | 846 |
| WP_017771984 | 779 | RQRYKLLDDGVK NLAS NILKEYP--TD---NQALQNERLFLYYLQNGRDMYTGEAL--D--IDNLSQYDIDHI | 846 |
| CFQ25032 | 779 | RQRYKLLDDGVK NLAS NILKEYP--TD---NQALQNERLFLYYLQNGRDMYTGEAL--D--IDNLSQYDIDHI | 846 |
| CFV16040 | 779 | RQRYKLLDDGVK NLAS NILKEYP--TD---NQALQNERLFLYYLQNGRDMYTGEAL--D--IDNLSQYDIDHI | 846 |
| KLJ37842 | 779 | RQRYKLLDDGVK NLAS NILKEYP--TD---NQALQNERLFLYYLQNGRDMYTGEAL--D--IDNLSQYDIDHI | 846 |
| KLJ72361 | 779 | RQRYKLLDDGVK NLAS NILKEYP--TD---NQALQNERLFLYYLQNGRDMYTGEAL--D--IDNLSQYDIDHI | 846 |
| KLL20707 | 793 | RQRYKLLDDGVK NLAS NILKEYP--TD---NQALQNERLFLYYLQNGRDMYTGEAL--D--IDNLSQYDIDHI | 860 |
| KLL42645 | 779 | RQRYKLLEEGVK NLAS NILKEYP--TD---NQALQNERLFLYYLQNGRDMYTGEAL--D--IDNLSQYDIDHI | 846 |
| WP_047207273 | 779 | RQRYKLLDDGVK NLAS NILKEYP--TD---NQALQNERLFLYYLQNGRDMYTGEAL--D--IDNLSQYDIDHI | 846 |
| WP_047209694 | 776 | RQRLTTLRESLA NLKS EKKPKYV--KDqveNHHLSDDRLFLYYLQNGKDMYTDDEL--D--IDNLSQYDIDHI | 846 |
| WP_050198062 | 779 | RQRYKLLDDGVK NLAS NILKEYP--TD---NQALQNERLFLYYLQNGRDMYTGEAL--D--IDNLSQYDIDHI | 846 |
| WP_050201642 | 779 | RQRYKLLDDGVK NLAS NILKEYP--TD---NQALQNERLFLYYLQNGRDMYTGEAL--D--IDNLSQYDIDHI | 846 |
| WP_050204027 | 779 | RQRYKLLEEGVK NLAS NILKEYP--TD---NQALQNERLFLYYLQNGRDMYTGEAL--D--IDNLSQYDIDHI | 846 |
| WP_050881965 | 779 | RQRYKLLDDGVK NLAS NILKEYP--TD---NQALQNERLFLYYLQNGRDMYTGEAL--D--IDNLSQYDIDHI | 846 |
| WP_050886065 | 779 | RQRYKLLDDGVK NLAS NILKEYP--TD---NQALQNERLFLYYLQNGRDMYTGEAL--D--IDNLSQYDIDHI | 846 |
| AHN30376 | 779 | RQRYKLLEDGVK NLAS DILKEYP--TD---NQALQNERLFLYYLQNGRDMYTGEAL--D--IDSLSQYDIDHI | 846 |
| EAO78426 | 779 | RQRYKLLDDGVK NLAS NILKEYP--TD---NQALQNERLFLYYLQNGRDMYTGEAL--D--IDNLSQYDIDHI | 846 |
| CCW42055 | 779 | RQRYKLLDDGVR NLAS NILKEYP--TD---NQALQNERLFLYYLQNGRDMYTEKAL--D--IDNLSQYDIDHI | 846 |
| WP_003041502 | 778 | QQRLKLLQDSLK PVNI K-----N--VE---NQQLQNDRLFLYYIQNGKDMYTGETL--D--INNLSQYDIDHI | 840 |
| WP_037593752 | 779 | QQRLKLLQDSLK PVNI K-----N--VE---NQQLQNDRLFLYYIQNGKDMYTGETL--D--INNLSQYDIDHI | 841 |
| WP_049516684 | 779 | QQRLKLLQDSLK PVNI K-----N--VE---NQQLQNDRLFLYYIQNGKDMYTGETL--D--INNLSQYDIDHI | 841 |
| GAD46167 | 778 | QQRLKLLQDSLK PVNI K-----N--VE---NQQLQNDRLFLYYIQNGKDMYTGETL--D--INNLSQYDIDHI | 840 |
| WP_018363470 | 779 | QQRLKKLQNSLK PSYI E----DK--VE---NSHLQNDQLFLYYIQNGKDMYTGDEL--D--IDHLSDYDIDHI | 849 |
| WP_003043819 | 787 | RERKKRIEEGIK ELES QILKENP--VE---NTQLQNEKLYLYYLQNGRDMYVDQEL--D--INRLSDYDVDHI | 850 |
| WP_006269658 | 778 | QQRLKLLQDSLK PVNI K-----N--VE---NQQLQNDRLFLYYIQNGKDMYTGETL--D--INNLSQYDIDHI | 840 |

```
WP_048800889   778 QQRLKLLQDSLT PVSI K-----N--VE---NQQLQNDRLFLYYIQNGKDMYTGEEL--D--IHHLSDYDIDHI   840

WP_012767106   777 RERMKRIEEGIK ELGS QILKEHP--VE---NTQLQNEKLYLYYLQNGRDMYVDQEL--D--INRLSDYDVDHI   840

WP_014612333   777 RERMKRIEEGIK ELGS QILKEHP--VE---NTQLQNEKLYLYYLQNGRDMYVDQEL--D--INRLSDYDVDHI   840

WP_015017095   777 RERMKRIEEGIK ELGS QILKEHP--VE---NTQLQNEKLYLYYLQNGRDMYVDQEL--D--INRLSDYDVDHI   840

WP_015057649   777 RERMKRIEEGIK ELGS QILKEHP--VE---NTQLQNEKLYLYYLQNGRDMYVDQEL--D--INRLSDYDVDHI   840

WP_048327215   777 RERMKRIEEGIK ELGS QILKEHP--VE---NTQLQNEKLYLYYLQNGRDMYVDQEL--D--INRLSDYDVDHI   840

WP_049519324   777 RERMKRIEEGIK ELGS QILKEHP--VE---NTQLQNEKLYLYYLQNGRDMYVDQEL--D--INRLSDYDVDHI   840

WP_012515931   777 RQRMRKLEETAK KLGS NILKEHP--VD---NSQLQNDKRYLYYLQNGKDMYTGDDL--D--IDYLSSYDIDHI   840

WP_021320964   777 RQRMRKLEETAK KLGS NILKEHP--VD---NSQLQNDKRYLYYLQNGKDMYTGDDL--D--IDYLSSYDIDHI   840

WP_037581760   777 RQRMRKLEETAK KLGS NILKEHP--VD---NSQLQNDKRYLYYLQNGKDMYTGDDL--D--IDYLSSYDIDHI   840

WP_004232481   778 NQRLKRLQDSLK PSYV D----SK--VE---NSHLQNDRLFLYYIQNGKDMYTGEEL--D--IDHLSDYDIDHI   848

WP_009854540   779 QQRLKKLQSSLK PSYI E----DK--VE---NSHLQNDQLFLYYIQNGKDMYTGDEL--D--IDHLSDYDIDHI   849

WP_012962174   779 QQRLKKLQDSLK PSYI E----GK--VE---NNHLQDDRLFLYYIQNGKDMYTGDEL--D--IDHLSDYDIDHI   849

WP_039695303   781 QQRLKKLQNSLK PSYI E----DK--VE---NSHLQNDQLFLYYIQNGKDMYTGDEL--D--IDHLSDYDIDHI   851

WP_014334983   778 NQRLKRLQDSLK PSYV D----SK--VE---NSHLQNDRLFLYYIQNGKDMYTGEEL--D--IDRLSDYDIDHI   848

WP_003099269   778 RQRLRKLEEVHK NTGS KILKEYN--VS---NTQLQSDRLYLYLLQDGKDMYTGKEL--D--YDNLSQYDIDHI   841

AHY15608       778 RQRLRKLEEVHK NTGS KILKEYN--VS---NTQLQSDRLYLYLLQDGKDMYTGKEL--D--YDNLSQYDIDHI   841

AHY17476       778 RQRLRKLEEVHK NTGS KILKEYN--VS---NTQLQSDRLYLYLLQDGKDMYTGKEL--D--YDNLSQYDIDHI   841

ESR09100           ------------ ---- ---------------------------------------------------------

AGM98575       778 RQRLRKLEEVHK NTGS KILKEYN--VS---NTQLQSDRLYLYLLQDGKDMYTGKEL--D--YDNLSQYDIDHI   841

ALF27331       778 QQRLKGLTDSIK EFGS QILKEHP--VE---NSQLQNDRLFLYYLQNGRDMYTGEEL--D--IDYLSQYDIDHI   841

WP_018372492   791 AQRLKKIEDGIK -LGS DLLKQNP--IQd--NKDLQKEKLFLYYMQNGIDLYTGQPLncD--PDSLAFYDVDHI   857

WP_045618028   777 QQRYKRIEDALK NLAH NILKEHP--TD---NIQLQNDRLFLYYLQNGKDMYTGKSL--D--INQLSSCDIDHI   844

WP_045635197   776 QQRYKRIEDSLK ILAS NILKENP--TD---NNQLQNDRLFLYYLQNGKDMYTGEAL--D--INQLSSYDIDHI   843

WP_002263549   778 QQRLKGLTDSIK EFGS QILKEHP--VE---NSQLQNDRLFLYYLQNGRDMYTGEEL--D--IDYLSQYDIDHI   841

WP_002263887   778 QQRLKGLTDSIK EFGS QILKEHP--VE---NSQLQNDRLFLYYLQNGRDMYTGEEL--D--IDYLSQYDIDHI   841

WP_002264920   778 QQRLKGLTDSIK EFGS QILKEHP--VE---NSQLQNDRLFLYYLQNGRDMYTGEEL--D--IDYLSQYDIDHI   841

WP_002269043   778 QQRLKGLTDSIK EFGS QILKEHP--VE---NSQLQNDRLFLYYLQNGRDMYTGEEL--D--IDYLSQYDIDHI   841

WP_002269448   778 QQRLKGLTDSIK EFGS QILKEHP--VE---NSQLQNDRLFLYYLQNGRDMYTGEEL--D--IDYLSQYDIDHI   841

WP_002271977   778 QQRLKGLTDSIK EFGS QILKEHP--VE---NSQLQNDRLFLYYLQNGRDMYTGEEL--D--IDYLSQYDIDHI   841

WP_002272766   778 QQRLKGLTDSIK EFGS QILKEHP--VE---NSQLQNDRLFLYYLQNGRDMYTGEEL--D--IDYLSQYDIDHI   841

WP_002273241   778 QQRLKGLTDSIK EFGS QILKEHP--VE---NSQLQNDRLFLYYLQNGRDMYTGEEL--D--IDYLSQYDIDHI   841

WP_002275430   778 QQRLKGLTDSIK EFGS QILKEHP--VE---NSQLQNDRLFLYYLQNGRDMYTGEEL--D--IDYLSQYDIDHI   841

WP_002276448   778 QQRLKGLTDSIK EFGS QILKEHP--VE---NSQLQNDRLFLYYLQNGRDMYTGEEL--D--IDYLSQYDIDHI   841

WP_002277050   779 QQRYKRLKEAIK DLNH KILKEHP--TD---NQALQNNRLFLYYLQNGRDMYTGESL--D--INRLSDYDIDHV   846

WP_002277364   778 QQRLKGLTDSIK EFGS QILKEHP--VE---HSQLQNDRLFLYYLQNGRDMYTGEEL--D--IDYLSQYDIDHI   841

WP_002279025   778 QQRLKGLTDSIK EFGS QILKEHP--VE---NSQLQNDRLFLYYLQNGRDMYTGEEL--D--IDYLSQYDIDHI   841

WP_002279859   778 QQRLKGLTDSIK EFGS QILKEHP--VE---NSQLQNDRLFLYYLQNGRDMYTGEEL--D--IDYLSQYDIDHI   841

WP_002280230   778 QQRLKGLTDSIK EFGS QILKEHP--VE---NSQLQNDRLFLYYLQNGRDMYTGEEL--D--IDYLSQYDIDHI   841

WP_002281696   778 QQRLKGLTDSIK EFGS QILKEHP--VE---NSQLQNDRLFLYYLQNGRDMYTGEEL--D--IDYLSQYDIDHI   841
```

-continued

```
WP_002282247   779 QQRYKRLKEAIK DLNH KILKEHP--TD---NQALQNNRLFLYYLQNGRDMYTGESL--D--INRLSDYDIDHV   846

WP_002282906   778 QQRLKGLTDSIK EFGS QILKEHP--VE---NSQLQNDRLFLYYLQNGRDMYTGEEL--D--IDYLSQYDIDHI   841

WP_002283846   778 QQRLKGLTDSIK EFGS QILKEHP--VE---NSQLQNDRLFLYYLQNGRDMYTGEEL--D--IDYLSQYDIDHI   841

WP_002287255   778 QQRLKGLTDSIK EFGS QILKEHP--VE---HSQLQNDRLFLYYLQNGRDMYTGEEL--D--IDYLSQYDIDHI   841

WP_002288990   778 QQRLKGLTDSIK EFGS QILKEHP--VE---NSQLQNDRLFLYYLQNGRDMYTGEEL--D--IDYLSQYDIDHI   841

WP_002289641   778 QQRLKGLTDSIK EFGS QILKEHP--VE---NSQLQNDRLFLYYLQNGRDMYTGEEL--D--IDYLSQYDIDHI   841

WP_002290427   778 QQRLKGLTDSIK EFGS QILKEHP--VE---NSQLQNDRLFLYYLQNGRDMYTGEEL--D--IDYLSQYDIDHI   841

WP_002295753   778 QQRLKGLTDSIK EFGS QILKEHP--VE---NSQLQNDRLFLYYLQNGRDMYTGEEL--D--IDYLSQYDIDHI   841

WP_002296423   778 QQRLKGLTDSIK EFGS QILKEHP--VE---NSQLQNDRLFLYYLQNGRDMYTGEEL--D--IDYLSQYDIDHI   841

WP_002304487   788 QKRYKRLEEAIK DLNH KILKEHP--TD---NQALQNDRLFLYYLQNGRDMYTEDPL--D--INRLSDYDIDHI   855

WP_002305844   778 QQRLKGLTDSIK EFGS QILKEHP--VE---NSQLQNDRLFLYYLQNGRDMYTGEEL--D--IDYLSQYDIDHI   841

WP_002307203   778 QQRLKGLTDSIK EFGS QILKEHP--VE---NSQLQNDRLFLYYLQNGRDMYTGEEL--D--IDYLSQYDIDHI   841

WP_002310390   778 QQRLKGLTDSIK EFGS QILKEHP--VE---NSQLQNDRLFLYYLQNGRDMYTGEEL--D--IDYLSQYDIDHI   841

WP_002352408   778 QQRLKGLTDSIK EFGS QILKEHP--VE---NSQLQNDRLFLYYLQNGRDMYTGEEL--D--IDYLSQYDIDHI   841

WP_012997688   778 QQRLKGLTDSIK EFGS QILKEHP--VK---HSQLQNDRLFLYYLQNGRDMYTGEEL--D--IDYLSQYDIDHI   841

WP_014677909   778 QQRLKGLTDSIK EFGS QILKEHP--VE---NSQLQNDRLFLYYLQNGRDMYTGEEL--D--IDYLSQYDIDHI   841

WP_019312892   778 QQRLKGLTDSIK EFGS QILKEHP--VE---NSQLQNDRLFLYYLQNGRDMYTGEEL--D--IDYLSQYDIDHI   841

WP_019313659   778 QQRLKGLTDSIK EFGS QILKEHP--VE---NSQLQNDRLFLYYLQNGRDMYTGEEL--D--IDYLSQYDIDHI   841

WP_019314093   778 QQRLKGLTDSIK EFGS QILKEHP--VE---NSQLQNDRLFLYYLQNGRDMYTGEEL--D--IDYLSQYDIDHI   841

WP_019315370   778 QQRLKGLTDSIK EFGS QILKEHP--VE---NSQLQNDRLFLYYLQNGRDMYTGEEL--D--IDYLSQYDIDHI   841

WP_019803776   778 QQRLKGLTDSIK EFGS QILKEHP--VE---NSQLQNDRLFLYYLQNGRDMYTGEEL--D--IDYLSQYDIDHI   841

WP_019805234   778 QQRLKGLTDSIK EFGS QILKEHP--VE---NSQLQNDRLFLYYLQNGRDMYTGEEL--D--IDYLSQYDIDHI   841

WP_024783594   778 QQRLKGLTDSIK EFGS QILKEHP--VE---NSQLQNDRLFLYYLQNGRDMYTGEEL--D--IDYLSQYDIDHI   841

WP_024784288   779 QQRYKRLKEAIK DLNH KILKEHP--TD---NQALQNNRLFLYYLQNGRDMYTGESL--D--INRLSDYDIDHV   846

WP_024784666   778 QQRLKGLTDSIK EFGS QILKEHP--VE---HSQLQNDRLFLYYLQNGRDMYTGEEL--D--IDYLSQYDIDHI   841

WP_024784894   778 QQRLKGLTDSIK EFGS QILKEHP--VE---NSQLQNDRLFLYYLQNGRDMYTGEEL--D--IDYLSQYDIDHI   841

WP_024786433   779 QQRYKRLKEAIK DLNH KILKEHP--TD---NQALQNNRLFLYYLQNGRDMYTGESL--D--INRLSDYDIDHV   846

WP_049473442   778 QQRLKGLTDSIK EFGS QILKEHP--VE---NSQLQNDRLFLYYLQNGRDMYTGEEL--D--IDYLSQYDIDHI   841

WP_049474547   778 QQRLKGLTDSIK EFGS QILKEHP--VE---NSQLQNDRLFLYYLQNGRDMYTGEEL--D--IDYLSQYDIDHI   841

EMC03581       771 QQRLKGLTDSIK EFGS QILKEHP--VE---HSQLQNDRLFLYYLQNGRDMYTGEEL--D--IDYLSQYDIDHI   834

WP_000428612   779 QQRYKRIEDSLK ILAS KILKEHP--TD---NIQLQNDRLFLYYLQNGRDMYTGKPL--D--INQLSSYDIDHI   846

WP_000428613   777 QQRYKRIEDALK NLAS NILKEHP--TN---NIQLQNDRLFLYYLQNGRDMYTGKPL--D--INQLSSYDIDHI   844

WP_049523028   776 QQRLKTLSDAIS ELG- NILKEHP--TD---NIQLQNDRLFLYYLQNGKDMYTGEAL--D--INQLSNYDIDHI   839

WP_003107102   747 RERLRKLEEVHK NIGS KILKEHE--IS---NAQLQSDRVYLYLLQDGKDMYTGKDL--D--FDRLSQYDIDHI   810

WP_054279288   779 RERMKRVQEVLK KLGS QLLKEHP--VE---NFQLQNERLYLYYLQNGKDMYTGEEL--S--ISNLSHYDIDHI   842

WP_049531101   777 QQRYKRIEDSLK ILAS NILKEHP--TD---NIQLQNDRLFLYYLQNGKDMYTGNPL--D--INHLSSYDIDHI   844

WP_049538452   777 QQRYKRIENSLK ILAS KILKEHP--TD---NNQLQNDRLFLYYLQNGKDMYTGEAL--D--INQLSSCDIDHI   844

WP_049549711   777 QQRYKRIEDSLK ILAS NILKENP--TD---NNQLQNDRLFLYYLQNGKDMYTGEAL--D--INQLSSYDIDHI   844

WP_007896501   781 RQRLKKIKEVHK KTGS RILEDNSerIT---NLTLQDNRLYLYLLQDGKDMYTGQDL--D--INNLSQYDIDHI   846

EFR44625       733 RQRLKKIKEVHK KTGS RILEDNSerIT---NLTLQDNRLYLYLLQDGKDMYTGQDL--D--INNLSQYDIDHI   798

WP_002897477   776 QQRYKRIEDALK NLAP NILKENP--TD---NIQLKNDRLFLYYLQNGKDMYTGKPL--D--INQLSSYDIDHI   843
```

-continued

```
WP_002906454    776  QQRYKRIEDALK NLAP NILKENP--TD---NIQLQNDRLFLYYLQNGKDMYTGKAI--D--INQLSNYDIDHI   843
WP_009729476    777  QQRYKRIEDSLK ILAS KILKEHP--TD---NIQLQNDRLFLYYLQNGKDMYTGEAL--D--INQLSSCDIDHI   844
CQR24647        780  QQRLGSLTKAIQ DFGS DILKRYP--VE---NNQLQNDQLYLYYLQNGKDMYTGDTL--D--IHNLSQYDIDHI   843
WP_000066813    779  QQRYKRIEDSLK NLAS NILKENP--TD---NIQLQNDRLFLYYLQNGRDMYTGKPL--E--INQLSNYDIDHI   846
WP_009754323    777  QQRYKRIEDALK NLAP TISKENP--TD---NIQLQNDRLFLYYLQNGKDMYTGEAL--D--INQLSSYDIDHI   844
WP_044674937    776  QQRYKKIENAIK NLNS KILKEYP--TN---NQALQNDRLFLYYLQNGKDMYTDEEL--D--IDQLSQYDIDHI   843
WP_044676715    778  QQRYKKIENAIK NLNS KILKEYP--TN---NQALQNDRLFLYYLQNGKDMYTDEEL--D--IDQLSQYDIDHI   845
WP_044680361    778  QQRYKKIENAIK NLNS KILKEYP--TN---NQALQNDRLFLYYLQNGKDMYTDEEL--D--IDQLSQYDIDHI   845
WP_044681799    776  QQRYKKIENAIK NLNS KILKEYP--TN---NQALQNDRLFLYYLQNGKDMYTDEEL--D--IDQLSQYDIDHI   843
WP_049533112    778  QQRLKLLQDSLK PVNI K-----N--VE---NQQLQNDRLFLYYIQNGKDMYTGETL--D--INNLSQYDIDHI   840
WP_029090905    753  TPRDKFIEKAYA ETDT EHLKELK---Qr--SKQLSSQRLFLYFIQNGKCMYSGEHL--D--IERLDSYEVDHI   823
WP_006506696    777  ESKIKKLENVYK DEQT SVLEELKg-FDn--TKKISSDSLFLYFTQLGKCMYSGKKL--D--IDSLDKYQIDHI   849
AIT42264        778  RERMKRIEEGIK ELGS QILKEHP--VE---NTQLQNEKLYLYYLQNGRDMYVDQEL--D--INRLSDYDVDHI   841
WP_034440723    785  KARLKKIQEGLE NLDS HVEKQAL---D---EEMLKSPKYYLYCLQNGKDIYTGKDL--D--IGQLQTYDIDHI   848
AKQ21048        778  RERMKRIEEGIK ELGS QILKEHP--VE---NTQLQNEKLYLYYLQNGRDMYVDQEL--D--INRLSDYDVDHI   841
WP_004636532    781  KERLEKLTEAIK EFDG --VKVKD--LK---NENLRNDRLYLYYLQNGRDMYTNEPL--D--INNLSKYDIDHI   845
WP_002364836    789  IQRLKIVEKAMA EIGS NLLKEQP--TT---NEQLRDTRLFLYYMQNGKDMYTGDEL--S--LHRLSHYDIDHI   852
WP_016631044    740  IQRLKIVEKAMA EIGS NLLKEQP--TT---NEQLRDTRLFLYYMQNGKDMYTGDEL--S--LHRLSHYDIDHI   803
EMS75795        525  KPRLKALEEALK SFDS PLLKEQP--VD---NQALQKDRLYLYYLQNGKDMYTGEAL--D--IDRLSEYDIDHI   588
WP_002373311    789  IQRLKIVEKAMA EIGS NLLKEQP--TT---NEQLRDTRLFLYYMQNGKDMYTGDEL--S--LHRLSHYDIDHI   852
WP_002378009    789  IQRLKIVEKAMA EIGS NLLKEQP--TT---NEQLRDTRLFLYYMQNGKDMYTGDEL--S--LHRLSHYDIDHI   852
WP_002407324    789  IQRLKIVEKAMA EIGS NLLKEQP--TT---NEQLRDTRLFLYYMQNGKDMYTGDEL--S--LHRLSHYDIDHI   852
WP_002413717    789  IQRLKIVEKAMA EIGS NLLKEQP--TT---NEQLRDTRLFLYYMQNGKDMYTGDEL--S--LHRLSHYDIDHI   852
WP_010775580    791  IQRLKIVEKAMA EIGS NLLKEQP--TT---NEQLRDTRLFLYYMQNGKDMYTGDEL--S--LHRLSHYDIDHI   854
WP_010818269    789  IQRLKIVEKAMA EIGS NLLKEQP--TT---NEQLRDTRLFLYYMQNGKDMYTGDEL--S--LHRLSHYDIDHI   852
WP_010824395    789  IQRLKIVEKAMA EIGS NLLKEQP--TT---NEQLRDTRLFLYYMQNGKDMYTGDEL--S--LHRLSHYDIDHI   852
WP_016622645    789  IQRLKIVEKAMA EIGS NLLKEQP--TT---NEQLRDTRLFLYYMQNGKDMYTGDEL--S--LHRLSHYDIDHI   852
WP_033624816    789  IQRLKIVEKAMA EIGS NLLKEQP--TT---NEQLRDTRLFLYYMQNGKDMYTGDEL--S--LHRLSHYDIDHI   852
WP_033625576    789  IQRLKIVEKAMA EIGS NLLKEQP--TT---NEQLRDTRLFLYYMQNGKDMYTGDEL--S--LHRLSHYDIDHI   852
WP_033789179    789  IQRLKIVEKAMA EIGS NLLKEQP--TT---NEQLRDTRLFLYYMQNGKDMYTGDEL--S--LHRLSHYDIDHI   852
WP_002310644    789  RPRLKALEESLK DFGS QLLKEYP--TD---NSSLQKDRLYLYYLQNGRDMYTGAPL--D--IHRLSDYDIDHI   852
WP_002312694    790  RPRLKALEESLK DFGS QLLKEYP--TD---NSSLQKDRLYLYYLQNGRDMYTGAPL--D--IHRLSDYDIDHI   853
WP_002314015    790  RPRLKALEESLK DFGS QLLKEYP--TD---NSSLQKDRLYLYYLQNGRDMYTGAPL--D--IHRLSDYDIDHI   853
WP_002320716    790  RPRLKALEESLK DFGS QLLKEYP--TD---NSSLQKDRLYLYYLQNGRDMYTGAPL--D--IHRLSDYDIDHI   853
WP_002330729    789  RPRLKALEESLK DFGS QLLKEYP--TD---NSSLQKDRLYLYYLQNGRDMYTGAPL--D--IHRLSDYDIDHI   852
WP_002335161    790  RPRLKALEESLK DFGS QLLKEYP--TD---NSSLQKDRLYLYYLQNGRDMYTGAPL--D--IHRLSDYDIDHI   853
WP_002345439    790  RPRLKALEESLK DFGS QLLKEYP--TD---NSSLQKDRLYLYYLQNGRDMYTGAPL--D--IHRLSDYDIDHI   853
WP_034867970    781  SPRLKALENGLK QIGS TLLKEQP--TD---NKALQKERLYLYYLQNGRDMYTGEPL--E--IENLHQYEVDHI   844
WP_047937432    790  RPRLKALEESLK DFGS QLLKEYP--TD---NSSLQKDRLYLYYLQNGRDMYTGAPL--D--IHRLSDYDIDHI   853
WP_010720994    781  KPRLKALENGLK QIGS TLLKEQP--TD---NKALQKERLYLYYLQNGRDMYTGEPL--E--IENLHQYEVDHI   844
```

-continued

```
WP_010737004    781 SPRLKALENGLK QIGS TLLKEQP--TD---NKALQKERLYLYYLQNGRDMYTGEPL--E--IENLHQYEVDHI    844
WP_034700478    781 KPRLKALENGLK QIGS TLLKEQP--TD---NKALQKERLYLYYLQNGRDMYTGEPL--E--IENLHQYEVDHI    844
WP_007209003    782 KPRLKGIENGLK EFSD SVLKGSS--ID---NKQLQNDRLYLYYLQNGKDMYTGHEL--D--IDHLSTYDIDHI    845
WP_023519017    775 RPRLKALEEALK NIDS PLLKDYP--TD---NQALQKDRLYLYYLQNGRDMYTGEPL--E--IHRLSEYDIDHI    838
WP_010770040    782 NPRMKALEEAMR NLRS NLLKEYP--TD---NQALQNDRLYLYYLQNGKDMYTGLDL--S--LHNLSSYDIDHI    845
WP_048604708    779 RPRLKNLEKAID DLDS EILKKHP--VD---NKALQKDRLYLYYLQNGKDMYTNEEL--D--IHKLSTYDIDHI    842
WP_010750235    784 KPRLKSLEEALK NEDS QLLKERP--VD---NQSLQKDRLYLYYLQNGKDMYTGESL--D--IDRLSEYDIDHI    847
AII16583        817 RERMKRIEEGIK ELGS QILKEHP--VE---NTQLQNEKLYLYYLQNGRDMYVDQEL--D--INRLSDYDVDHI    880
WP_029073316    789 DSFVNQMLKLYK DFED EANKHLKg-EDa--KSKIRSERLKLYYTQMGKCMYTGKSL--D--IDRLDTYQVDHI    860
WP_031589969    789 DSFVNQMLKLYK DFED EANKHLKg-EDa--KSKIRSERLKLYYTQMGKCMYTGKSL--D--IDRLDTYQVDHI    860
KDA45870        772 EDRVQQIVKNLK ELPK ------P---S---NAELSDERKYLYCLQNGRDMYTGAPL--D--YDHLQFYDVDHI    833
WP_039099354    789 KRQVEQVYQNIS EL-- EIRNELK---Dl-SNSALSNTRLFLYFMQGGRDMYTGDSL--N--IDRLSTYDIDHI    856
AKP02966        786 RLQSKLLNKANG -LVP EELKKHKn--D------LSSERIMLYFLQNGKSLYSEESL--N--INKLSDYQVDHI    858
WP_010991369    781 RPRYKSLEKAIK EFGS QILKEHP--TD---NQELRNNRLYLYYLQNGKDMYTGQDL--D--IHNLSNYDIDHI    844
WP_033838504    781 RPRYKSLEKAIK EFGS QILKEHP--TD---NQELRNNRLYLYYLQNGKDMYTGQDL--D--IHNLSNYDIDHI    844
EHN60060        784 RPRYKSLEKAIK EFGS QILKEHP--TD---NQELRNNRLYLYYLQNGKDMYTGQDL--D--IHNLSNYDIDHI    847
EFR89594        550 RPRYKSLEKAIK EFGS QILKEHP--TD---NQELKNNRLYLYYLQNGKDMYTGQDL--D--IHNLSNYDIDHI    613
WP_038409211    781 KPRFISLEKAIK EFGS QILKEHP--TD---NQCLKNDRLYLYYLQNGKDMYTGKEL--D--IHNLSNYDIDHI    844
EFR95520        400 KPRFISLEKAIK EFGS QILKEHP--TD---NQCLKNDRLYLYYLQNGKDMYTGKEL--D--IHNLSNYDIDHI    463
WP_003723650    781 KPRYKSLEKAIK EFGS QILKEHP--TD---NQELKNNRLYLYYLQNGKDMYTGQEL--D--IHNLSNYDIDHI    844
WP_003727705    781 KPRYKSLEKAIK DFGS QILKEHP--TD---NQELKNNRLYLYYLQNGKDIYTGQEL--D--IHNLSNYDIDHI    844
WP_003730785    781 KPRYKSLEKAIK DFGS QILKEHP--TD---NQELKNNRLYLYYLQNGKDIYTGQEL--D--IHNLSNYDIDHI    844
WP_003733029    781 KPRYKSLEKAIK EFGS QILKEHP--TD---NQELKNNRLYLYYLQNGKDMYTGQEL--D--IHNLSNYDIDHI    844
WP_003739838    781 RPRYKSLEKAIK EFGS QILKEHP--TD---NQELRNNRLYLYYLQNGKDMYTGQEL--D--IHNLSNYDIDHI    844
WP_014601172    781 KPRYKSLEKAIK EFGS KILKEHP--TD---NQELKNNRLYLYYLQNGKDMYTGQEL--D--IHNLSNYDIDHI    844
WP_023548323    781 KPRYKSLEKAIK EFGS QILKEHP--TD---NQELKNNRLYLYYLQNGKDMYTGQEL--D--IHNLSNYDIDHI    844
WP_031665337    781 KPRYKSLEKAIK EFGS QILKEHP--TD---NQELKNNRLYLYYLQNGKDMYTGQEL--D--IHNLSNYDIDHI    844
WP_031669209    781 KPRYKSLEKAIK EFGS QILKEHP--TD---NQELKNNRLYLYYLQNGKDMYTGQEL--D--IHNLSNYDIDHI    844
WP_033920898    781 KPRYKSLEKAIK EFGS QILKEHP--TD---NQELKNNRLYLYYLQNGKDMYTGQEL--D--IHNLSNYDIDHI    844
AKI42028        784 KPRYKSLEKAIK EFGS KILKEHP--TD---NQELKNNRLYLYYLQNGKDMYTGQEL--D--IHNLSNYDIDHI    847
AKI50529        784 KPRYKSLEKAIK EFGS QILKEHP--TD---NQELKNNRLYLYYLQNGKDMYTGQEL--D--IHNLSNYDIDHI    847
EFR83390        229 RPRYKSLEKAIK EFGS QILKEHP--TD---NQELKNNRLYLYYLQNGKDIYTGQEL--D--IHNLSNYDIDHI    292
WP_046323366    781 KPRFTSLEKAIK ELGS QILKEHP--TD---NQGLKNDRLYLYYLQNGKDMYTGQEL--D--IHNLSNYDIDHV    844
AKE81011        794 RERMKRIEEGIK ELGS QILKEHP--VE---NTQLQNEKLYLYYLQNGRDMYVDQEL--D--INRLSDYDVDHI    857
CUO82355        781 ESKIKKLENVYK DEQT SVLEELKg-FDn--TKKISSDSLFLYFTQLGKCMYSGKKL--D--IDSLDKYQIDHI    853
WP_033162887    784 ESKIAKLQKIYE NLQT QVYESLKK-EDa--KKRMETDALYLYYLQMGKSMYSGKPL--D--IDKLSTYQIDHI    855
AGZ01981        811 RERMKRIEEGIK ELGS QILKEHP--VE---NTQLQNEKLYLYYLQNGRDMYVDQEL--D--INRLSDYDVDHI    874
AKA60242        778 RERMKRIEEGIK ELGS QILKEHP--VE---NTQLQNEKLYLYYLQNGRDMYVDQEL--D--INRLSDYDVDAI    841
AKS40380        778 RERMKRIEEGIK ELGS QILKEHP--VE---NTQLQNEKLYLYYLQNGRDMYVDQEL--D--INRLSDYDVDHI    841
4UN5_B          782 RERMKRIEEGIK ELGS QILKEHP--VE---NTQLQNEKLYLYYLQNGRDMYVDQEL--D--INRLSDYDVDAI    845
```

-continued

| | | | |
|---|---|---|---|
| WP_010922251 | 842 | VPQSFLKDDSIDNKVLTRSDKNRG-KSDN--VP S--EEVKKMKN-YWRQLLNAKLITQRKFDNLTKA--ERG GLSE | 910 |
| WP_039695303 | 852 | IPQAFIKDDSIDNRVLTSSAKNRG-KSDD--VP S--LDIVRARKA-EWVRLYKSGLISKRKFDNLTKA--ERGGLTE | 920 |
| WP_045635197 | 844 | IPQAFIKDDSLDNRVLTSSKDNRG-KSDN--VP S--IEVVQKRKA-FWQQLLDSKLISERKENNLTKA--ERGGLDE | 912 |
| 5AXW_A | 562 | IPRSVSFDNSFNNKVLVKQEEASK-KGNR--TP Fqy-LSSSDSKI-SYETFKKHILNLAKGKGRISKTK-KEYLLEE | 632 |
| WP_009880683 | 526 | VPQSFLKDDSIDNKVLTRSDKNRG-KSDN--VP S--EEVVKKMKN-YWKQLLNAKLITQRKFDNLTKA--ERGGLSE | 594 |
| WP_010922251 | 842 | VPQSFLKDDSIDNKVLTRSDKNRG-KSDN--VP S--EEVVKKMKN-YWRQLLNAKLITQRKFDNLTKA--ERGGLSE | 910 |
| WP_011054416 | 842 | VPQSFLKDDSIDNKVLTRSDKNRG-KSDN--VP S--EEVVKKMKN-YWRQLLNAKLITQRKFDNLTKA--ERGGLSE | 910 |
| WP_011284745 | 842 | VPQSFIKDDSIDNKVLTRSDKNRG-KSNN--VP S--EEVVKKMKN-YWRQLLNAKLITQRKFDNLTKA--ERGGLSE | 910 |
| WP_011285506 | 842 | VPQSFLKDDSIDNKVLTRSDKNRG-KSDN--VP S--EEVVKKMKN-YWRQLLNAKLITQRKFDNLTKA--ERGGLSE | 910 |
| WP_011527619 | 842 | VPQSFIKDDSIDNKVLTRSDKNRG-KSDN--VP S--EEVVKKMKN-YWRQLLNAKLITQRKFDNLTKA--ERGGLSE | 910 |
| WP_012560673 | 842 | VPQSFLKDDSIDNKVLTRSDKNRG-KSDN--VP S--EEVVKKMKN-YWRQLLNAKLITQRKFDNLTKA--ERGGLSE | 910 |
| WP_014407541 | 841 | VPQSFIKDDSIDNKVLTRSDKNRG-KSDN--VP S--EEVVKKMKN-YWRQLLNAKLITQRKFDNLTKA--ERGGLSE | 909 |
| WP_020905136 | 842 | VPQSFIKDDSIDNKVLTRSDKNRG-KSDN--VP S--EEVVKKMKN-YWRQLLNAKLITQRKFDNLTKA--ERGGLSE | 910 |
| WP_023080005 | 841 | VPQSFLKDDSIDNKVLTRSDKNRG-KSDN--VP S--EEVVKKMKN-YWRQLLNAKLITQRKEDNLTKA--ERGGLSE | 909 |
| WP_023610282 | 841 | VPQSFLKDDSIDNKVLTRSDKNRG-KSDN--VP S--EEVVKKMKN-YWRQLLNAKLITQRKEDNLTKA--ERGGLSE | 909 |
| WP_030125963 | 842 | VPQSFIKDDSIDNKVLTRSDKNRG-KSDN--VP S--EEVVKKMKN-YWRQLLNAKLITQRKFDNLTKA--ERGGLSE | 910 |
| WP_030126706 | 842 | VPQSFLKDDSIDNKVLTRSDKNRG-KSDN--VP S--EEVVKKMKN-YWRQLLNAKLITQRKFDNLTKA--ERGGLSE | 910 |
| WP_031488318 | 842 | VPQSFLKDDSIDNKVLTRSDKNRG-KSDN--VP S--EEVVKKMKN-YWRQLLNAKLITQRKFDNLTKA--ERGGLSE | 910 |
| WP_032460140 | 842 | VPQSFLKDDSIDNKVLTRSDKNRG-KSDN--VP S--EEVVKKMKN-YWRQLLNAKLITQRKFDNLTKA--ERGGLSE | 910 |
| WP_032461047 | 842 | VPQSFLKDDSIDNKVLTRSDKNRG-KSDN--VP S--EEVVKKMKN-YWRQLLNAKLITQRKFDNLTKA--ERGGLSE | 910 |
| WP_032462016 | 842 | VPQSFLKDDSIDNKVLTRSDKNRG-KSDN--VP S--EEVVKKMKN-YWRQLLNAKLITQRKFDNLTKA--ERGGLSE | 910 |
| WP_032462936 | 842 | VPQSFLKDDSIDNKVLTRSDKNRG-KSDN--VP S--EEVVKKMKN-YWRQLLNAKLITQRKFDNLTKA--ERGGLSE | 910 |
| WP_032464890 | 842 | VPQSFIKDDSIDNKVLTRSDKNRG-KSDN--VP S--EEVVKKMKN-YWRQLLNAKLITQRKFDNLTKA--ERGGLSE | 910 |
| WP_033888930 | 667 | VPQSFLKDDSIDNKVLTRSDKNRG-KSDN--VP S--EEVVKKMKN-YWRQLLNAKLITQRKFDNLTKA--ERGGLSE | 735 |
| WP_038431314 | 842 | VPQSFLKDDSIDNKVLTRSDKNRG-KSDN--VP S--EEVVKKMKN-YWRQLLNAKLITQRKFDNLTKA--ERGGLSE | 910 |
| WP_038432938 | 841 | VPQSFLKDDSIDNKVLTRSDKNRG-KSDN--VP S--EEVVKKMKN-YWRQLLNAKLITQRKFDNLTKA--ERGGLSE | 909 |
| WP_038434062 | 842 | VPQSFLKDDSIDNKVLTRSDKNRG-KSDN--VP S--EEVVKKMKN-YWRQLLNAKLITQRKFDNLTKA--ERGGLSE | 910 |
| BAQ51233 | 753 | VPQSFLKDDSIDNKVLTRSDKNRG-KSDN--VP S--EEVVKKMKN-YWRQLLNAKLITQRKFDNLTKA--ERGGLSE | 821 |
| KGE60162 | 17 | VPQSFLKDDSIDNKVLTRSDKNRG-KSDN--VP S--EEVVKKMKN-YWRQLLNAKLITQRKFDNLTKA--ERGGLSE | 85 |
| KGE60856 | | -------------------------------- ------------------------------------------ | |
| WP_002989955 | 842 | VPQSFIKDDSIDNKVLTRSDKNRG-KSDN--VP S--EEVVKKMKN-YWRQLLNAKLITQRKFDNLTKA--ERGGLSE | 910 |
| WP_003030002 | 841 | IPQAFIKDNSLDNRVLTRSDKNRG-KSDD--VP S--IEVVHEMKS-FWSKLLSVKLITQRKEDNLTKA--ERGGLTE | 909 |
| WP_003065552 | 852 | IPQAFIKDDSIDNRVLTSSAKNRG-KSDD--VP S--LDIVRARKA-EWVRLYKSGLISKRKFDNLTKA--ERGGLTE | 920 |
| WP_001040076 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_001040078 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_001040080 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_001040081 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_001040083 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_001040085 | 847 | IPQAFIKDDSIDNRVLVSSAKNRG-KSDD--VP S--LEIVKDCKV-FWKKLLDAKLMSQRKYDNLTKA--ERGGLTS | 915 |
| WP_001040087 | 847 | IPQAFIKDDSIDNRVLVSSAKNRG-KSDD--VP S--LEIVKDCKV-FWKKLLDAKLMSQRKYDNLTKA--ERGGLTS | 915 |

-continued

```
WP_001040088   847 IPQAFIKDDSIDNRVLVSSAKNRG-KSDD--VP S--LEIVKDCKV-FWKKLLDAKLMSQRKYDNLTKA--ERGGLTS  915

WP_001040089   847 IPQAFIKDDSIDNRVLVSSAKNRG-KSDD--VP S--LEIVKDCKV-FWKKLLDAKLMSQRKYDNLTKA--ERGGLTS  915

WP_001040090   847 IPQAFIKDDSIDNRVLVSSAKNRG-KSDD--VP S--LEIVKDCKV-FWKKLLDAKLMSQRKYDNLTKA--ERGGLTS  915

WP_001040091   847 IPQAFIKDDSIDNRVLVSSAKNRG-KSDD--VP S--LEIVKDCKV-FWKKLLDAKLMSQRKYDNLTKA--ERGGLTS  915

WP_001040092   847 VPQAFIKDDSIDNRVLVSSAKNRG-KSDD--VP S--IDIVKARKA-FWKKLLDAKLISQRKYDNLTKA--ERGGLTP  915

WP_001040094   847 IPQAFIKDDSIDNRVLVSSAKNRG-KSDD--VP S--VEIVKDCKV-FWKKLLDAKLMSQRKYDNLTKA--ERGGLTS  915

WP_001040095   847 IPQAFIKDDSIDNRVLVSSAKNRG-KSDD--VP S--LEIVKDCKV-FWKKLLDAKLMSQRKYDNLTKA--ERGGLTS  915

WP_001040096   847 IPQAFIKDDSIDNRVLVSSAKNRG-KSDD--VP S--LEIVKDCKV-FWKKLLDAKLMSQRKYDNLTKA--ERGGLTS  915

WP_001040097   847 IPQAFIKDDSIDNRVLVSSAKNRG-KSDD--VP S--VEIVKDCKV-FWKKLLDAKLMSQRKYDNLTKA--ERGGLTS  915

WP_001040098   847 IPQAFIKDDSIDNRVLVSSAKNRG-KSDD--VP S--VEIVKDCKV-FWKKLLDAKLMSQRKYDNLTKA--ERGGLTS  915

WP_001040099   847 IPQAFIKDDSIDNRVLVSSAKNRG-KSDD--VP S--VEIVKDCKV-FWKKLLDAKLMSQRKYDNLTKA--ERGGLTS  915

WP_001040100   847 IPQAFIKDDSIDNRVLVSSAKNRG-KSDD--VP S--VEIVKDCKV-FWKKLLDAKLMSQRKYDNLTKA--ERGGLTS  915

WP_001040104   847 IPQAFIKDDSIDNRVLVSSAKNRG-KSDD--VP S--LEIVKDCKV-FWKKLLDAKLMSQRKYDNLTKA--ERGGLTS  915

WP_001040105   847 IPQAFIKDDSIDNRVLVSSAKNRG-KSDD--VP S--LEIVKDCKV-FWKKLLDAKLMSQRKYDNLTKA--ERGGLTS  915

WP_001040106   847 VPQAFIKDDSIDNRVLVSSAKNRG-KSDN--VP S--IDIVKARKA-FWKKLLDAKLMSQRKYDNLTKA--ERGGLTS  915

WP_001040107   847 VPQAFIKDDSIDNRVLVSSAKNRG-KSDN--VP S--IDIVKARKA-FWKKLLDAKLMSQRKYDNLTKA--ERGGLTS  915

WP_001040108   847 VPQAFIKDDSIDNRVLVSSAKNRG-KSDN--VP S--IDIVKARKA-FWKKLLDAKLMSQRKYDNLTKA--ERGGLTS  915

WP_001040109   847 VPQAFIKDDSIDNRVLVSSAKNRG-KSDN--VP S--IDIVKARKA-FWKKLLDAKLMSQRKYDNLTKA--ERGGLTS  915

WP_001040110   847 VPQAFIKDDSIDNRVLVSSAKNRG-KSDN--VP S--IDIVKARKA-FWKKLLDAKLMSQRKYDNLTKA--ERGGLTS  915

WP_015058523   847 VPQAFIKDDSIDNRVLVSSAKNRG-KSDD--VP S--IDIVKARKA-FWKKLLDAKLISQRKYDNLTKA--ERGGLTP  915

WP_017643650   847 IPQAFIKDDSIDNRVLVSSAKNRG-KSDD--VP S--VEIVKDCKV-FWKKLLDAKLMSQRKYDNLTKA--ERGGLTS  915

WP_017647151   847 IPQAFIKDDSIDNRVLVSSAKNRG-KSDD--VP S--LEIVKDCKV-FWKKLLDAKLMSQRKYDNLTKA--ERGGLTS  915

WP_017648376   847 IPQAFIKDDSIDNRVLVSSAKNRG-KSDD--VP S--LEIVKDCKV-FWKKLLDAKLMSQRKYDNLTKA--ERGGLTS  915

WP_017649527   847 IPQAFIKDDSIDNRVLVSSAKNRG-KSDD--VP S--LEIVKDCKV-FWKKLLDAKLMSQRKYDNLTKA--ERGGLTS  915

WP_017771611   847 VPQAFIKDDSIDNRVLVSSAKNRG-KSDN--VP S--IDIVKARKA-FWKKLLDAKLMSQRKYDNLTKA--ERGGLTS  915

WP_017771984   847 IPQAFIKDDSIDNRVLVSSAKNRG-KSDD--VP S--LEIVKDCKV-FWKKLLDAKLMSQRKYDNLTKA--ERGGLTS  915

CFQ25032       847 IPQAFIKDDSIDNRVLVSSAKNRG-KSDD--VP S--LEIVKDCKV-FWKKLLDAKLMSQRKYDNLTKA--ERGGLTS  915

CFV16040       847 IPQAFIKDDSIDNRVLVSSAKNRG-KSDD--VP S--LEIVKDCKV-FWKKLLDAKLMSQRKYDNLTKA--ERGGLIS  915

KLJ37842       847 IPQAFIKDDSIDNRVLVSSAKNRG-KSDD--VP S--LEIVKDCKV-FWKKLLDAKLMSQRKYDNLTKA--ERGGLTS  915

KLJ72361       847 IPQAFIKDDSIDNRVLVSSAKNRG-KSDD--VP S--LEIVKDCKV-FWKKLLDAKLMSQRKYDNLTKA--ERGGLTS  915

KLL20707       861 IPQAFIKDDSIDNRVLVSSAKNRG-KSDD--VP S--LEIVKDCKV-FWKKLLDAKLMSQRKYDNLTKA--ERGGLTS  929

KLL42645       847 VPQAFIKDDSIDNRVLVSSAKNRG-KSDN--VP S--IDIVKARKA-FWKKLLDAKLMSQRKYDNLTKA--ERGGLTS  915

WP_047207273   847 IPQAFIKDDSIDNRVLVSSAKNRG-KSDD--VP S--LEIVKDCKV-FWKKLLDAKLMSQRKYDNLTKA--ERGGLTS  915

WP_047209694   847 IPQAFIKDDSIDNRVLVSSAKNRG-KSDD--VP S--VEIVKDCKV-FWKKLLDAKLMSQRKYDNLTKA--ERGGLTS  915

WP_050198062   847 IPQAFIKDDSIDNRVLVSSAKNRG-KSDD--VP S--LEIVKDCKV-FWKKLLDAKLMSQRKYDNLTKA--ERGGLTS  915

WP_050201642   847 IPQAFIKDDSIDNRVLVSSAKNRG-KSDD--VP S--LEIVKDCKV-FWKKLLDAKLMSQRKYDNLTKA--ERGGLTS  915

WP_050204027   847 VPQAFIKDDSIDNRVLVSSAKNRG-KSDN--VP S--IDIVKARKA-FWKKLLDAKLMSQRKYDNLTKA--ERGGLTS  915

WP_050881965   847 IPQAFIKDDSIDNRVLVSSAKNRG-KSDD--VP S--LEIVKDCKV-FWKKLLDAKLMSQRKYDNLTKA--ERGGLTS  915

WP_050886065   847 IPQAFIKDDSIDNRVLVSSAKNRG-KSDD--VP S--LEIVKDCKV-FWKKLLDAKLMSQRKYDNLTKA--ERGGLTS  915

AHN30376       847 VPQAFIKDDSIDNRVLVSSAKNRG-KSDD--VP S--IDIVKARKA-FWKKLLDAKLISQRKYDNLTKA--ERGGLTP  915

EAO78426       847 IPQAFIKDDSIDNRVLVSSAKNRG-KSDD--VP S--LEIVKDCKV-FWKKLLDAKLMSQRKYDNLTKA--ERGGLTS  915
```

-continued

```
CCW42055         847  IPQAFIKDDSIDNRVLVSSAKNRG-KSDD--VP S--LEIVKDCKV-FWKKLLDAKLMSQRKYDNLTKA--ERGGLTS  915
WP_003041502     841  IPQAYIKDDSFDNRVLTSSSENRG-KSDN--VP S--IEVVCARKA-DWMRLRKAGLISQRKFDNLTKA--ERGGLTE  909
WP_037593752     842  IPQAFIKDNSLDNRVLTRSDKNRG-KSDD--VP S--IEVVHEMKS-FWSKLLSVKLITQRKFDNLTKA--ERGGLTE  910
WP_049516684     842  IPQAFIKDNSLDNRVLTRSDKNRG-KSDD--VP S--IEVVHEMKS-FWSKLLSVKLITQRKFDNLTKA--ERGGLTE  910
GAD46167         841  IPQAFIKDNSLDNRVLTRSDKNRG-KSDD--VP S--IEVVHEMKS-FWSKLLSVKLITQRKFDNLTKA--ERGGLTE  909
WP_018363470     850  IPQAFIKDDSIDNRVLTSSAKNRG-KSDD--VP S--LGIVRARKA-EWVRLYKSGLISKRKFDNLTKA--ERGGLTE  918
WP_003043819     851  VPQSFIKDDSIDNKVLTRSVENRG-KSDN--VP S--EEVVKKMKN-YWRQLLNAKLITQRKFDNLTKA--ERGGLSE  919
WP_006269658     841  IPQAFIKDNSLDNRVLTRSDKNRG-KSDD--VP S--IEVVHEMKS-FWSKLLSVKLITQRKEDNLTKA--ERGGLTE  909
WP_048800889     841  IPQAFIKDDSIDNRVLTSSAKNRG-KSDD--VP N--LEVVCDRKA-DWIRLREAGLISQRKFDNLTKA--ERGGLTE  909
WP_012767106     841  VPQSFIKDDSIDNKILTRSDKNRG-KSDN--VP S--EEVVKKMKN-YWRQLLNAKLITQRKFDNLTKA--ERGGLSE  909
WP_014612333     841  VPQSFIKDDSIDNKVLTRSDKNRG-KSDN--VP S--EEVVKKMKN-YWRQLLNAKLITQRKFDNLTKA--ERGGLSE  909
WP_015017095     841  VPQSFIKDDSIDNKVLTRSDKNRG-KSDD--VP S--EEVVKKMKN-YWRQLLNAKLITQRKFDNLTKA--ERGGLSE  909
WP_015057649     841  VPQSFIKDDSIDNKVLTRSDKNRG-KSDN--VP S--EEVVKKMKN-YWRQLLNAKLITQRKFDNLTKA--ERGGLSE  909
WP_048327215     841  VPQSFIKDDSIDNKVLTRSDKNRG-KSDN--VP S--EEVVKKMKN-YWRQLLNAKLITQRKFDNLTKA--ERGGLSE  909
WP_049519324     841  VPQSFIKDDSIDNKVLTRSDKNRG-KSDN--VP S--EEVVKKMKN-YWRQLLNAKLITQRKFDNLTKA--ERGGLSE  909
WP_012515931     841  IPQSFIKNNSIDNKVLTSQGANRG-KLDN--VP S--EAIVRKMKG-YWQSLLRAGAISKQKFDNLTKA--ERGGLTQ  909
WP_021320964     841  IPQSFIKNNSIDNKVLTSQGANRG-KLDN--VP S--EAIVRKMKG-YWQSLLRAGAISKQKFDNLTKA--ERGGLTQ  909
WP_037581760     841  IPQSFIKNNSIDNKVLTSQGANRG-KLDN--VP S--EAIVRKMKG-YWQSLLRAGAISKQKFDNLTKA--ERGGLTQ  909
WP_004232481     849  IPQAFIKDNSIDNRVLTSSAKNRG-KSDD--VP S--IEIVRNRKS-YWYKLYKSGLISKRKFDNLTKA--ERGGLTE  917
WP_009854540     850  IPQAFIKDDSIDNRVLTSSAKNRG-KSDD--VP S--LDIVRARKA-EWVRLYKSGLISKRKFDNLTKA--ERGGLTE  918
WP_012962174     850  IPQAFIKDDSIDNRVLTSSAKNRG-KSDD--VP S--LDIVHDRKA-DWIRLYKSGLISKRKFDNLTKA--ERGGLTE  918
WP_039695303     852  IPQAFIKDDSIDNRVLTSSAKNRG-KSDD--VP S--LDIVRARKA-EWVRLYKSGLISKRKFDNLTKA--ERGGLTE  920
WP_014334983     849  IPQAFIKDNSIDNKVLTSSAKNRG-KSDD--VP S--IEIVRNRRS-YWYKLYKSGLISKRKFDNLTKA--ERGGLTE  917
WP_003099269     842  IPQSFIKDNSIDNTVLTTQASNRG-KSDN--VP N--IETVNKMKS-FWYKQLKSGAISQRKFDHLTKA--ERGALSD  910
AHY15608         842  IPQSFIKDNSIDNTVLTTQASNRG-KSDN--VP N--IETVNKMKS-FWYKQLKSGAISQRKFDHLTKA--ERGALSD  910
AHY17476         842  IPQSFIKDNSIDNTVLTTQASNRG-KSDN--VP N--IETVNKMKS-FWYKQLKSGAISQRKFDHLTKA--ERGALSD  910
ESR09100         ------------------------------    -------------------------------------------
AGM98575         842  IPQSFIKDNSIDNTVLTTQASNRG-KSDN--VP N--IETVNKMKS-FWYKQLKSGAISQRKFDHLTKA--ERGALSD  910
ALF27331         842  IPQAFIKDNSIDNRVLTSSKENRG-KSDD--VP S--KDVVRKMKS-YWSKLLSAKLITQRKFDNLTKA--ERGGLTD  910
WP_018372492     858  VPRSYIKNDSFDNKVLTTSKGNRK-KLDD--VP A--KEVVEKMEN-TWRRLHAAGLISDIKLSYLMKGe-----LTE  923
WP_045618028     845  IPQAFIKDDSLDNRVLTSSKDNRG-KSDN--VP S--LEIVQKRKA-FWQQLLDSKLISERKENNLTKA--ERGGLDE  913
WP_045635197     844  IPQAFIKDDSLDNRVLTSSKDNRG-KSDN--VP S--IEVVQKRKA-FWQQLLDSKLISERKENNLTKA--ERGGLDE  912
WP_002263549     842  IPQAFIKDNSIDNRVLTSSKENRG-KSDD--VP S--KDVVRKMKS-YWSKLLSAKLITQRKFDNLTKA--ERGGLTD  910
WP_002263887     842  IPQAFIKDNSIDNRVLTSSKENRG-KSDD--VP S--KDVVRKMKS-YWSKLLSAKLITQRKEDNLTKA--ERGGLTD  910
WP_002264920     842  IPQAFIKDNSIDNRVLTSSKENRG-KSDD--VP S--KDVVRKMKS-YWSKLLSAKLITQRKFDNLTKG--ERGGLTD  910
WP_002269043     842  IPQAFIKDNSIDNRVLTSSKENRG-KSDD--VP S--KDVVRKMKS-YWSKLLSAKLITQRKFDNLTKA--ERGGLTD  910
WP_002269448     842  IPQAFIKDNSIDNRVLTSSKENRG-KSDD--VP S--EDVVRKMKS-YWSKLLSAKLITQRKFDNLTKA--ERGGLTD  910
WP_002271977     842  IPQAFIKDNSIDNRVLTSSKENRG-KSDD--VP S--KDVVRKMKS-YWSKLLSAKLITQRKFDNLTKA--ERGGLTD  910
WP_002272766     842  IPQAFIKDNSIDNRVLTSSKENRG-KSDD--VP S--KDVVRKMKP-YWSKLLSAKLITQRKFDNLTKA--ERGGLTD  910
WP_002273241     842  IPQAFIKDNSIDNRVLTSSKENRG-KSDD--VP S--KDVVRKMKS-YWSKLLSAKLITQRKFDNLTKA--ERGGLTD  910
```

```
WP_002275430    842 IPQAFIKDNSIDNRVLTSSKENRG-KSDD--VP S--KDVVRKMKP-YWSKLLSAKLITQRKFDNLTKA--ERGGLTD    910

WP_002276448    842 IPQAFIKDNSIDNRVLTSSKENRG-KSDD--VP S--KDVVRKMKS-YWSKLLSAKLITQRKFDNLTKA--ERGGLTD    910

WP_002277050    847 IPQAFIKDNSIDNRVLTSSKANRG-KSDD--VP S--EDVVNRMRP-FWNKLLSSGLISQRKYNNLTKK--E---LTP    912

WP_002277364    842 IPQAFIKDNSIDNRVLTSSKENRG-KSDD--VP S--KNVVRKMKS-YWSKLLSAKLITQRKFDNLTKA--ERGGLTD    910

WP_002279025    842 IPQAFIKDNSIDNRVLTSSKENRG-KSDD--VP S--KDVVRKMKP-YWSKLLSAKLITQRKFDNLTKA--ERGGLTD    910

WP_002279859    842 IPQAFIKDNSIDNRVLTSSKENRG-KSDD--VP S--KDVVRKMKS-YWSKLLSAKLITQRKFDNLTKG--ERGGLTD    910

WP_002280230    842 IPQAFIKDNSIDNRVLTSSKENRG-KSDD--VP S--KDVVRKMKS-YWSKLLSAKLITQRKFDNLTKA--ERGGLTD    910

WP_002281696    842 IPQAFIKDNSIDNRVLTSSKENRG-KSDD--VP S--KNVVRKMKS-YWSKLLSAKLITQRKFDNLTKA--ERGGLTD    910

WP_002282247    847 IPQAFIKDNSIDNRVLTSSKANRG-KSDD--VP S--EDVVNRMRP-FWNKLLSSGLISQRKYNNLTKK--E---LTL    912

WP_002282906    842 IPQAFIKDNSIDNRVLTSSKENRG-KSDD--VP S--KDVVRKMKS-YWSKLLSAKLITQRKFDNLTKA--ERGGLTD    910

WP_002283846    842 IPQAFIKDNSIDNRVLTSSKENRG-KSDD--VP S--KNVVRKMKS-YWSKLLSAKLITQRKFDNLTKA--ERGGLTD    910

WP_002287255    842 IPQAFIKDNSIDNRVLTSSKENRG-KSDD--VP S--KNVVRKMKS-YWSKLLSAKLITQRKFDNLTKA--ERGGLTD    910

WP_002288990    842 IPQAFIKDNSIDNRVLTSSKENRG-KSDD--VP S--KDVVRKMKS-YWSKLLSAKLITQRKFDNLTKA--ERGGLTD    910

WP_002289641    842 IPQAFIKDNSIDNRVLTSSKENRG-KSDD--VP S--KDVVRKMKS-YWSKLLSAKLITQRKFDNLTKA--ERGGLTD    910

WP_002290427    842 IPQAFIKDNSIDNRVLTSSKENRG-KSDD--VP S--KDVVRKMKS-YWSKLLSAKLITQRKFDNLTKG--ERGGLTD    910

WP_002295753    842 IPQAFIKDNSIDNRVLTSSKENRG-KSDD--VP S--KDVVRKMKS-YWSKLLSAKLITQRKFDNLTKA--ERGGLTD    910

WP_002296423    842 IPQAFIKDNSIDNRVLTSSKENRG-KSDD--VP S--KNVVRKMKS-YWSKLLSAKLITQRKEDNLTKA--ERGGLTD    910

WP_002304487    856 IPQAFIKDNSIDNRVLTRSDKNRG-KSDD--VP S--EEVVHKMKP-FWSKLLSAKLITQRKFDNLTKA--ERGGLTD    924

WP_002305844    842 IPQAFIKDNSIDNRVLTSSKENRG-KSDD--VP S--KDVVRKMKS-YWSKLLSAKLITQRKFDNLTKA--ERGGLTD    910

WP_002307203    842 IPQAFIKDNSIDNRVLTSSKENRG-KSDD--VP S--KDVVRKMKS-YWSKLLSAKLITQRKEDNLTKA--ERGGLTD    910

WP_002310390    842 IPQAFIKDNSIDNRVLTSSKENRG-KSDD--VP S--KDVVRKMKS-YWSKLLSAKLITQRKEDNLTKG--ERGGLTD    910

WP_002352408    842 IPQAFIKDNSIDNRVLTSSKENRG-KSDD--VP S--KDVVRKMKS-YWSKLLSAKLITQRKFDNLTKA--ERGGLTD    910

WP_012997688    842 IPQAFIKDNSIDNRVLTSSKENRG-KSDD--VP S--KNVVRKMKS-YWSKLLSAKLITQRKFDNLTKA--ERGGLTD    910

WP_014677909    842 IPQAFIKDNSIDNRVLTSSKENRG-KSDD--VP S--KDVVRKMKS-YWSKLLSAKLITQRKFDNLTKA--ERGGLTD    910

WP_019312892    842 IPQAFIKDNSIDNRVLTSSKENRG-KSDD--VP S--KNVVRKMKS-YWSKLLSAKLITQRKFDNLTKA--ERGGLTD    910

WP_019313659    842 IPQAFIKDNSIDNRVLTSSKENRG-KSDD--VP S--KDVVRKMKS-YWSKLLSAKLITQRKFDNLTKA--ERGGLTD    910

WP_019314093    842 IPQAFIKDNSIDNRVLTSSKENRG-KSDD--VP S--KDVVRKMKS-YWSKLLSAKLITQRKFDNLTKA--ERGGLTD    910

WP_019315370    842 IPQAFIKDNSIDNRVLTSSKENRG-KSDD--VP S--KDVVRKMKP-YWSKLLSAKLITQRKEDNLTKA--ERGGLTD    910

WP_019803776    842 IPQAFIKDNSIDNRVLTSSKENRG-KSDD--VP S--KDVVRKMKS-YWSKLLSAKLITQRKEDNLTKA--ERGGLTD    910

WP_019805234    842 IPQAFIKDNSIDNRVLTSSKENRG-KSDD--VP S--KDVVRKMKS-YWSKLLSAKLITQRKFDNLTKG--ERGGLTD    910

WP_024783594    842 IPQAFIKDNSIDNRVLTSSKENRG-KSDD--VP S--KDVVRKMKS-YWSKLLSAKLITQRKFDNLTKA--ERGGLTD    910

WP_024784288    847 IPQAFIKDNSIDNRVLISSKANRG-KSDD--VP S--EDVVNRMRP-FWNKLLSSGLISQRKYNNLTKK--E---LTL    912

WP_024784666    842 IPQAFIKDNSIDNRVLTSSKENRG-KSDD--VP S--KNVVRKMKS-YWSKLLSAKLITQRKFDNLTKA--ERGGLTD    910

WP_024784894    842 IPQAFIKDNSIDNRVLTSSKENRG-KSDD--VP S--KDVVRKMKS-YWSKLLSAKLITQRKFDNLTKA--ERGGLTD    910

WP_024786433    847 IPQAFIKDNSIDNRVLTSSKANRG-KSDD--VP S--EDVVNRMRP-FWNKLLSSGLISQRKYNNLTKK--E---LTL    912

WP_049473442    842 IPQAFIKDNSIDNRVLTSSKENRG-KSDD--VP S--KDVVRKMKP-YWSKLLSAKLITQRKFDNLTKA--ERGGLTD    910

WP_049474547    842 IPQAFIKDNSIDNRVLTSSKENRG-KSDD--VP S--KDVVRKMKS-YWSKLLSAKLITQRKEDNLTKA--ERGGLTD    910

EMC03581        835 IPQAFIKDNSIDNRVLTSSKENRG-KSDD--VP S--KNVVRKMKS-YWSKLLSAKLITQRKFDNLTKA--ERGGLTD    903

WP_000428612    847 VPQAFIKDDSLDNRVLTSLKDNRG-KSDN--VP S--LEVVEKMKT-FWQQLLDSKLISYRKENNLTKA--ERGGLDE    915

WP_000428613    845 VPQAFIKDDSLDNRVLTSLKDNRG-KSDN--VP S--IEVVQKRKA-FWQQLLDSKLISERKENNLTKA--ERGGLDE    913

WP_049523028    840 IPQAFIKDDSLDNRVLTSSKDNRG-KSDN--VP S--LEIVEKMKG-FWQQLLDSKLISERKENNLTKA--ERGGLDE    908
```

-continued

```
WP_003107102  811 IPQSFIKDNSIDNIVLTSQESNRG-KSDN--VP Y--IAIVNKMKS-YWQHQLKSGAISQRKFDNLTKA--ERGGLSE  879
WP_054279288  843 IPRSFIKDDSIDNKVLTRSEHNRG-KTDN--VP S--IEVVKRMKP-YWQKLLDTKVISQRKFDNLTKA--ERGGLQE  911
WP_049531101  845 IPQAFIKDDSLDNRVLTSSKDNRG-KSDN--VP S--LEVVQKRKA-FWQQLLESKLISERKENNLTKA--ERGGLNE  913
WP_049538452  845 IPQAFIKDDSLDNRVLTSSKENRG-KSDN--VP C--LEVVDKMKV-FWQQLLDFKLISYRKENNLTKA--ERGGLDE  913
WP_049549711  845 IPQAFIKDDSLDNRVLTSSKDNRG-KSDN--VP S--LEVVQKRKA-FWQQLLDSKLISERKENNLTKAerERDGLNE  915
WP_007896501  847 IPQSFIKDNSIDNLVLTTQKANRG-KSDN--VP S--IEVVRDMKDrVWRRQLANGAISRQKFDHLTKA--ERGGLAD  916
EFR44625      799 IPQSFIKDNSIDNLVLTTQKANRG-KSDN--VP S--IEVVRDMKDrVWRRQLANGAISRQKFDHLTKA--ERGGLAD  868
WP_002897477  844 IPQAFIKDDSIDNRVLISSKDNRG-KSDN--VP S--LEVVQKRKA-FWQQLLDSKLISERKENNLTKA--ERGGLDE  912
WP_002906454  844 IPQAFIKDDSLDNRVLTSSKDNRG-KSDN--VP S--IEVVQKRKA-FWQQLLDSKLISERKENNLTKA--KRGGLDE  912
WP_009729476  845 IPQAFIKDDSLDNRVLTSSKDNRG-KSDN--VP S--LEVVDKMKV-FWQQLLDSKLISYRKENNLTKA--ERGGLNE  913
CQR24647      844 IPQSFIKDNSLDNRVLINSKSNRG-KSDN--VP S--NEVVKRMKG-FWLKQLDAKLISQRKFDNLTKA--ERGGLSA  912
WP_000066813  847 IPQAFIKDDSLDNRVLTSSKDNRG-KSDN--VP S--LEVVEKMKA-FWQQLLDSKLISERKENNLTKAerERGGLNE  917
WP_009754323  845 IPQAFIKDDSLDNRVLISSKDNRG-KSDN--VP S--LEVVKKRKA-FWQQLLDSKLISERKENNLTKA--ERGGLDE  913
WP_044674937  844 IPQAFIKDDSLDNKVLTKSAKNRG-KSDD--VP S--LEIVHKKKN-FWKQLLDSQLISQRKFDNLTKA--ERGGLIN  912
WP_044676715  846 IPQAFIKDDSLDNKVLTKSAKNRG-KSDD--VP S--LEIVHKKKN-FWKQLLDSQLISQRKFDNLTKA--ERGGLIN  914
WP_044680361  846 IPQAFIKDDSLDNKVLTKSAKNRG-KSDD--VP S--LEIVHKKKN-FWKQLLDSQLISQRKEDNLTKA--ERGGLIN  914
WP_044681799  844 IPQAFIKDDSLDNKVLTKSAKNRG-KSDD--VP S--LEIVHKKKN-FWKQLLDSQLISQRKFDNLTKA--ERGGLIN  912
WP_049533112  841 IPQAFIKDDSFDNRVLTSSSENRG-KSDN--VP S--IEVVRARKA-DWMRLRKAGLISQRKFDNLTKA--ERGGLTE  909
WP_029090905  824 LPQSYIKDNSIENLALVKKVENQR-KKDSllLN S---SIINQNYS-RWEQLKNAGLIGEKKFRNLTRTk-----ITD  890
WP_006506696  850 VPQSLVKDDSFDNRVLVVPSENQR-KLDDlvVP ---FDIRDKMYR-FWKLLFDHELISPKKFYSLIKTe-----YTE  916
AIT42264      842 VPQSFLKDDSIDNKVLTRSDKNRG-KSDN--VP S--EEVVKKMKN-YWRQLLNAKLITQRKFDNLTKA--ERGGLSE  910
WP_034440723  849 IPRSFITDNSFDNLVLTSSTVNRG-KLDN--VP Sp--DIVRQQKG-FWKQLLRAGLMSQRKENNLTKGk-----LTD  914
AKQ21048      842 VPQSFLKDDSIDNKVLTRSDKNRG-KSDN--VP S--EEVVKKMKN-YWRQLLNAKLITQRKFDNLTKA--ERGGLSE  910
WP_004636532  846 IPQSFTTDNSIDNKVLVSRTKNQGnKSDD--VP S--INIVHKMKP-FWRQLHKAGLISDRKFKNLTKA--EHGGLTE  915
WP_002364836  853 IPQSFMKDDSLDNLVLVGSTENRG-KSDD--VP S--KEVVKDMKA-YWEKLYAAGLISQRKFQRLTKG--EQGGLTL  921
WP_016631044  804 IPQSFMKDDSLDNLVLVGSTENRG-KSDD--VP S--KEVVKDMKA-YWEKLYAAGLISQRKFQRLTKG--EQGGLTL  872
EMS75795      589 IPRSFIVDNSIDNKVLVSSKENRL-KMDD--VP D--QKVVIRMRR-YWEKLLRANLISERKFAYLTKLe-----LTP  654
WP_002373311  853 IPQSFMKDDSLDNLVLVGSTENRG-KSDD--VP S--KKVVKKMKA-YWEKLYAAGLISQRKFQRLTKG--EQGGLTL  921
WP_002378009  853 IPQSFMKDDSLDNLVLVGSTENRG-KSDD--VP S--KEVVKDMKA-YWEKLYAAGLISQRKFQRLTKG--EQGGLTL  921
WP_002407324  853 IPQSFMKDDSLDNLVLVGSTENRG-KSDD--VP S--KEVVKDMKA-YWEKLYAAGLISQRKFQRLTKG--EQGGLTL  921
WP_002413717  853 IPQSFMKDDSLDNLVLVGSTENRG-KSDD--VP S--KEVVKDMKA-YWEKLYAAGLISQRKFQRLTKG--EQGGLTL  921
WP_010775580  855 IPQSFMKDDSLDNLVLVGSTENRG-KSDD--VP S--KEVVKKMKA-YWEKLYAAGLISQRKFQRLTKG--EQGGLTL  923
WP_010818269  853 IPQSFMKDDSLDNLVLVGSTENRG-KSDD--VP S--KEVVKDMKA-YWEKLYAAGLISQRKFQRLTKG--EQGGLTL  921
WP_010824395  853 IPQSFMKDDSLDNLVLVGSTENRG-KSDD--VP S--KEVVKDMKA-YWEKLYAAGLISQRKFQRLTKG--EQGGLTL  921
WP_016622645  853 IPQSFMKDDSLDNLVLVGSTENRG-KSDD--VP S--KEVVKDMKA-YWEKLYAAGLISQRKFQRLTKG--EQGGLTL  921
WP_033624816  853 IPQSFMKDDSLDNLVLVGSTENRG-KSDD--VP S--KEVVKKMKA-YWEKLYAAGLISQRKFQRLTKG--EQGGLTL  921
WP_033625576  853 IPQSFMKDDSLDNLVLVGSTENRG-KSDD--VP S--KEVVKKMKA-YWEKLYAAGLISQRKFQRLTKG--EQGGLTL  921
WP_033789179  853 IPQSFMKDDSLDNLVLVGSTENRG-KSDD--VP S--KEVVKKMKA-YWEKLYAAGLISQRKFQRLTKG--EQGGLTL  921
WP_002310644  853 IPRSFTTDNSIDNKVLVSSKENRL-KKDD--VP S--EKVVKKMRS-FWYDLYSSKLISKRKLDNLTKIk-----LTE  918
WP_002312694  854 IPRSFTTDNSIDNKVLVSSKENRL-KKDD--VP S--EKVVKKMRS-FWYDLYSSKLISKRKLDNLTKIk-----LTE  919
```

-continued

```
WP_002314015    854 IPRSFTTDNSIDNKVLVSSKENRL-KKDD--VP S--EKVVKKMRS-FWYDLYSSKLISKRKLDNLTKIk-----LTE    919

WP_002320716    854 IPRSFTTDNSIDNKVLVSSKENRL-KKDD--VP S--EKVVKKMRS-FWYDLYSSKLISKRKLDNLTKIk-----LTE    919

WP_002330729    853 IPRSFTTDNSIDNKVLVSSKENRL-KKDD--VP S--EKVVKKMRS-FWYDLYSSKLISKRKLDNLTKIk-----LTE    918

WP_002335161    854 IPRSFTTDNSIDNKVLVSSKENRL-KKDD--VP S--EKVVKKMRS-FWYDLYSSKLISKRKLDNLTKIk-----LTE    919

WP_002345439    854 IPRSFTTDNSIDNKVLVSSKENRL-KKDD--VP S--EKVVKKMRS-FWYDLYSSKLISKRKLDNLTKIk-----LTE    919

WP_034867970    845 IPRSFIVDNSIDDKVLVASKQNQK-KRDD--VP K--KQIVNEQRI-FWNQLKEAKLISTKKYAYLTKIe-----LTP    910

WP_047937432    854 IPRSFTTDNSIDNKVLVSSKENRL-KKDD--VP S--EKVVKKMRS-FWYDLYSSKLISKRKLDNLTKIK-----LTE    919

WP_010720994    845 IPRSFIVDNSIDDKVLVASKQNQK-KRDD--VP K--KQIVNEQRI-FWNQLKEAKLISPKKYAYLTKIe-----LTP    910

WP_010737004    845 IPRSFIVDNSIDDKVLVASKQNQK-KRDD--VP K--KQIVNEQRI-FWNQLKEAKLISPKKYAYLTKIe-----LTP    910

WP_034700478    845 IPRSFIVDNSIDDKVLVASKQNQK-KRDD--VP N--KQIVNEQRI-FWNQLKEAKLISPKKYAYLTKIe-----LTP    910

WP_007209003    846 IPQSFLTDNSIDNRVLTTSKSNRG-KSDN--VP S--EEVVRKMDR-FWRKLLNAKLISERKYTNLTKKe-----LTE    911

WP_023519017    839 IPRSFIVDNSLDNKVLVSSKVNRG-KLDN--AP D--PLVVKRMRS-HWEKLHQAKLISDKKLANLTKQn-----LTE    904

WP_010770040    846 VPQSFTTDNSLDNRVLVSSKENRG-KKDD--VP S--KEVVQKNIT-LWETLKNSNLISQKKYDNLTKG--LRGGLTE    914

WP_048604708    843 IPQSFIVDNSLDNRVLVSSSKNRG-KLDD--VP S--KEVVKKMRA-FWESLYRSGLISKKKFDNLVKA--ESGGLSE    911

WP_010750235    848 IPRSFIVDHSLDNKVLVSSKENRL-KKDD--VP D--SKVVKRMKA-YWEKLLRANLISERKFSYLTKLe-----LTD    913

AII16583        881 VPQSFLKDDSIDNKVLTRSDKNRG-KSDN--VP S--EEVVKKMKN-YWRQLLNAKLITQRKFDNLTKA--ERGGLSE    949

WP_029073316    861 VPQSLLKDDSIDNKVLVLSSENQR-KLDDlvIP ---EMIRNKMFG-FWNKLYENKIISPKKFYSLIKSe-----YSD    927

WP_031589969    861 VPQSLLKDDSIDNKVLVLSSENQR-KLDDlvIP ---SSIRNKMYG-FWEKLENNKIISPKKFYSLIKTe-----FNE    927

KDA45870        834 IPQSFLKDDSIENKVLTIKKENVR-KING--LP S--EAVIQKMGS-FWKKLLDAGAMTNKKYDNLRRN1--HGGLNE    902

WP_039099354    857 LPQSFIKDNSLDNRVLVSQRMNRS-KADQ--VP S--VELGQKMQI -QWEQMLRAGLITKKKYDNLTLNp-------    923

AKP02966        859 LPRTYIPDDSLENKALVLAKENQR-KADDllLN S---NVIDKNLE-RWTYMLNNNMMGLKKFKNLTRRV-----ITD    925

WP_010991369    845 VPQSFITDNSIDNLVLTSSAGNRE-KGDD--VP P--LEIVRKRKV-FWEKLYQGNLMSKRKFDYLTKA--ERGGLTE    913

WP_033838504    845 VPQSFITDNSIDNLVLTSSAGNRE-KGDD--VP P--LEIVRKRKV-FWEKLYQGNLMSKRKFDYLTKA--ERGGLTE    913

EHN60060        848 VPQSFITDNSIDNLVLTSSAGNRE-KGDD--VP P--LEIVRKRKV-FWEKLYQGNLMSKRKFDYLTKA--ERGGLTE    916

EFR89594        614 VPQSFITDNSIDNLVLTSSAGNRE-KGND--VP P--LEIVQKRKV-FWEKLYQGNLMSKRKFDYLTKA--ERGGLTE    682

WP_038409211    845 IPQSFITDNSIDNRVLVSSTANRE-KGDN--VP L--LEVVRKRKA-FWEKLYQAKLMSKRKFDYLTKA--ERGGLTE    913

EFR95520        464 IPQSFITDNSIDNRVLVSSTANRE-KGDN--VP L--LEVVRKRKA-FWEKLYQAKLMSKRKFDYLTKA--ERGGLTE    532

WP_003723650    845 VPQSFITDNSIDNLVLTSSAGNRE-KGGD--VP P--LEIVRKRKV-FWEKLYQGNLMSKRKFDYLTKA--ERGGLTE    913

WP_003727705    845 VPQSFITDNSIDNLVLTSSAGNRE-KGGD--VP P--LEIVRKRKV-FWEKLYQGNLMSKRKFDYLTKA--ERGGLTE    913

WP_003730785    845 VPQSFITDNSIDNLVLTSSAGNRE-KGGD--VP P--LEIVRKRKV-FWEKLYQGNLMSKRKFDYLTKA--ERGGLTE    913

WP_003733029    845 VPQSFITDNSVDNLVLTSSAGNRE-KGDN--VP P--LEIVQKRKI-FWEKLYQGNLMSKRKEDYLTKA--ERGGLTE    913

WP_003739838    845 VPQSFITDNSIDNLVLTSSAGNRE-KGDD--VP P--LEIVRKRKV-FWEKLFQGNLMSKRKEDYLTKA--ERGGLTE    913

WP_014601172    845 VPQSFITDNSIDNLVLTSSAGNRE-KGGD--VP P--LEIVRKRKV-FWEKLYQGNLMSKRKFDYLTKA--ERGGLTD    913

WP_023548323    845 VPQSFITDNSIDNLVLTSSAGNRE-KGDN--VP P--LEIVQKRKI-FWEKLYQGNLMSKRKFDYLTKA--ERGGLTE    913

WP_031665337    845 VPQSFITDNSIDNLVLTSSAGNRE-KGGD--VP P--LEIVRKRKV-FWEKLYQGNLMSKRKFDYLTKA--ERGGLTE    913

WP_031669209    845 VPQSFITDNSVDNLVLTSSAGNRE-KGDN--VP P--LEIVQKRKI-FWEKLYQGNLMSKRKFDYLTKA--ERGGLTE    913

WP_033920898    845 VPQSFITDNSIDNLVLTSSAGNRE-KGDN--VP P--LEIVQKRKI-FWEKLYQGNLMSKRKFDYLTKA--ERGGLTE    913

AKI42028        848 VPQSFITDNSIDNLVLTSSAGNRE-KGGD--VP P--LEIVRKRKV-FWEKLYQGNLMSKRKEDYLTKA--ERGGLTD    916

AKI50529        848 VPQSFITDNSIDNLVLTSSAGNRE-KGDN--VP P--LEIVQKRKI-FWEKLYQGNLMSKRKEDYLTKA--ERGGLTE    916

EFR83390        293 VPQSFITDNSIDNLVLTSSAGNRE-KGDD--VP P--LEIVRKRKV-FWEKLYQGNLMSKRKFDYLTKA--ERGGLTE    361

WP_046323366    845 VPQSFITDNSIDNRVLASSAANRE-KGDN--VP S--LEVVRKRKV-YWEKLYQAKLMSKRKFDYLTKA--ERGGLTE    913
```

-continued

```
AKE81011        858 VPQSFLKDDSIDNKVLTRSDKNRG-KSDN--VP  S--EEVVKKMKN-YWRQLLNAKLITQRKFDNLTKA--ERGGLSE    926

CU082355        854 VPQSLVKDDSFDNRVLVLPSENQR-KLDDlvVP ---FDIRDKMYR-FWKLLFDHELISPKKFYSLIKTe-----YTE    920

WP_033162887    856 LPQSLIKDDSFDNRVLVLPEENQW-KLDSetVP ---FEIRNKMIG-FWQMLHENGLMSNKKFFSLIRTd-----FSD    922

AGZ01981        875 VPQSFLKDDSIDNKVLTRSDKNRG-KSDN--VP  S--EEVVKKMKN-YWRQLLNAKLITQRKFDNLTKA--ERGGLSE    943

AKA60242        842 VPQSFLKDDSIDNKVLTRSDKNRG-KSDN--VP  S--EEVVKKMKN-YWRQLLNAKLITQRKFDNLTKA--ERGGLSE    910

AKS40380        842 VPQSFLKDDSIDNKVLTRSDKNRG-KSDN--VP  S--EEVVKKMKN-YWRQLLNAKLITQRKFDNLTKA--ERGGLSE    910

4UN5_B          846 VPQSFLKDDSIDNKVLTRSDKNRG-KSDN--VP  S--EEVVKKMKN-YWRQLLNAKLITQRKFDNLTKA--ERGGLSE    914

WP_010922251    911 LD  KAGFIKRQLVETRQITKHVAQILDSRMNTKYDENDKLIR--EVKVITLKSKLVSDFRKDF    QFYKVREINNY    981

WP_039695303    921 AD  KAGFIKRQLVETRQITKHVAQILDARFNTEHDENDKVIR--DVKVITLKSNLVSQFRKDF    EFYKVREINDY    991

WP_045635197    913 RD  KVGFIKRQLVETRQITKHVAQILDARYNTEVNEKDKKNR--TVKIITLKSNLVSNFRKEF    RLYKVREINDY    983

5AXW_A          633 RD  QKDFINRNLVDTRYATRGLMNLLRSYER---------VNnlDVKVKSINGGFTSFLRRKW    KFKKERNKGYK    702

WP_009880683    595 LD  KAGFIKRQLVETRQITKHVAQILDSRMNTKYDENDKLIR--EVRVITLKSKLVSDERKDF    QFYKVREINNY    665

WP_010922251    911 LD  KAGFIKRQLVETRQITKHVAQILDSRMNTKYDENDKLIR--EVKVITLKSKLVSDFRKDF    QFYKVREINNY    981

WP_011054416    911 LD  KVGFIKRQLVETRQITKHVAQILDSRMNTKYDENDKLIR--EVRVITLKSKLVSDFRKDF    QFYKVREINNY    981

WP_011284745    911 LD  KAGFIKRQLVETRQITKHVAQILDSRMNTKYDENDKLIR--EVKVITLKSKLVSDFRKDF    QFYKVREINNY    981

WP_011285506    911 LD  KAGFIKRQLVETRQITKHVAQILDSRMNTKYDENDKLIR--EVKVITLKSKLVSDERKDF    QFYKVREINNY    981

WP_011527619    911 LD  KAGFIKRQLVETRQITKHVAQILDSRMNTKYDENDKLIR--EVKVITLKSKLVSDERKDF    QFYKVREINNY    981

WP_012560673    911 LD  KAGFIKRQLVETRQITKHVAQILDSRMNTKYDENDKLIR--EVKVITLKSKLVSDFRKDF    QFYKVREINNY    981

WP_014407541    910 LD  KAGFIKRQLVETRQITKHVAQILDSRMNTKYDENDKLIR--EVKVITLKSKLVSDFRKDF    QFYKVREINNY    980

WP_020905136    911 LD  KAGFIKRQLVETRQITKHVAQILDSRMNTKYDENDKLIR--EVKVITLKSKLVSDFRKDF    QFYKVREINNY    981

WP_023080005    910 LD  KAGFIKRQLVETRQITKHVAQILDSRMNTKYDENDKLIR--EVKVITLKSKLVSDFRKDF    QFYKVREINNY    980

WP_023610282    910 LD  KAGFIKRQLVETRQITKHVAQILDSRMNTKYDENDKLIR--EVKVITLKSKLVSDFRKDF    QFYKVREINNY    980

WP_030125963    911 LD  KAGFIKRQLVETRQITKHVAQILDSRMNTKYDENDKLIR--EVKVITLKSKLVSDFRKDF    QFYKVREINNY    981

WP_030126706    911 LD  KAGFIKRQLVETRQITKHVAQILDSRMNTKYDENDKLIR--EVKVITLKSKLVSDFRKDF    QFYKVREINNY    981

WP_031488318    911 LD  KAGFIKRQLVETRQITKHVAQILDSRMNTKYDENDKLIR--EVKVITLKSKLVSDERKDF    QFYKVREINNY    981

WP_032460140    911 LD  KAGFIKRQLVETRQITKHVAQILDSRMNTKYDENDKLIR--EVKVITLKSKLVSDFRKDF    QFYKVREINNY    981

WP_032461047    911 LD  KAGFIKRQLVETRQITKHVAQILDSRMNTKYDENDKLIR--EVKVITLKSKLVSDFRKDF    QFYKVREINNY    981

WP_032462016    911 LD  KAGFIKRQLVETRQITKHVAQILDSRMNTKYDENDKLIR--EVKVITLKSKLVSDFRKDF    QFYKVREINNY    981

WP_032462936    911 LD  KAGFIKRQLVETRQITKHVAQILDSRMNTKYDENDKLIR--EVKVITLKSKLVSDERKDE    QFYKVREINNY    981

WP_032464890    911 LD  KAGFIKRQLVETRQITKHVAQILDSRMNTKYDENDKLIR--EVKVITLKSKLVSDERKDF    QFYKVREINNY    981

WP_033888930    736 LD  KAGFIKRQLVETRQITKHVAQILDSRMNTKYDENDKLIR--EVKVITLKSKLVSDFRKDF    QFYKVREINNY    806

WP_038431314    911 LD  KAGFIKRQLVETRQITKHVAQILDSRMNTKYDENDKLIR--EVKVITLKSKLVSDFRKDF    QFYKVREINNY    981

WP_038432938    910 LD  KAGFIKRQLVETRQITKHVAQILDSRMNTKYDENDKLIR--EVKVITLKSKLVSDERKDE    QFYKVREINNY    980

WP_038434062    911 LD  KAGFIKRQLVETRQITKHVAQILDSRMNTKYDENDKLIR--EVKVITLKSKLVSDERKDE    QFYKVREINNY    981

BAQ51233        822 LD  KAGFIKRQLVETRQITKHVAQILDSRMNTKYDENDKLIR--EVKVITLKSKLVSDFRKDF    QFYKVREINNY    892

KGE60162         86 LD  KVGFIKRQLVETRQITKHVAQILDSRMNTKYDENDKLIR--EVRVITLKSKLVSDFRKDF    QFYKVREINNY    156

KGE60856            -- ------------------------------------------------ -----------

WP_002989955    911 LD  KAGFIKRQLVETRQITKHVAQILDSRMNTKYDENDKLIR--EVKVITLKSKLVSDFRKDF    QFYKVREINNY    981

WP_003030002    910 ED  KAGFIKRQLVETRQITKHVAQILDERENTEFDGNKRRIR--NVKIITLKSNLVSNFRKEF    ELYKVREINDY    980

WP_003065552    921 AD  KAGFIKRQLVETRQITKHVAQILDARFNTESDENDKVIR--DVKVITLKSNLVSQFRKDE    EFYKVREINDY    991
```

-continued

| | | | |
|---|---|---|---|
| WP_001040076 | 916 | DD KARFIQRQLVETRQITKHVARILDERFNNELDSKGRRIR--KVKIVTLKSNLVSNFRKEF VFYKIREVNNY | 986 |
| WP_001040078 | 916 | DD KARFIQRQLVETRQITKHVARILDERFNNELDSKGRRIR--KVKIVTLKSNLVSNERKEF GFYKIREVNDY | 986 |
| WP_001040080 | 916 | DD KARFIQRQLVETRQITKHVARILDERFNNELDSKGRRIR--KVKIVTLKSNLVSNERKEF GFYKIREVNNY | 986 |
| WP_001040081 | 916 | DD KARFIQRQLVETRQITKHVARILDERENNELDSKGRRIR--KVKIVTLKSNLVSNERKEF GFYKIREVNNY | 986 |
| WP_001040083 | 916 | DD KARFIQRQLVETRQITKHVARILDERFNNELDSKGRRIR--KVKIVTLKSNLVSNERKEF GFYKIREVNNY | 986 |
| WP_001040085 | 916 | DD KARFIQRQLVETRQITKHVARILDERFNNELDSKGRRIR--KVKIVTLKSNLVSNERKEF GFYKIREVNNY | 986 |
| WP_001040087 | 916 | DD KARFIQRQLVETRQITKHVARILDERENNELDSKGRRIR--KVKIVTLKSNLVSNERKEF GFYKIREVNNY | 986 |
| WP_001040088 | 916 | DD KARFIQRQLVETRQITKHVARILDERENNELDSKGRRIR--KVKIVTLKSNLVSNERKEF GFYKIREVNNY | 986 |
| WP_001040089 | 916 | DD KARFIQRQLVETRQITKHVARILDERENNELDSKGRRIR--KVKIVTLKSNLVSNERKEF GFYKIREVNNY | 986 |
| WP_001040090 | 916 | DD KARFIQRQLVETRQITKHVARILDERENNELDSKGRRIR--KVKIVTLKSNLVSNERKEF GFYKIREVNNY | 986 |
| WP_001040091 | 916 | DD KARFIQRQLVETRQITKHVARILDERENNELDSKGRRIR--KVKIVTLKSNLVSNERKEF GFYKIREVNNY | 986 |
| WP_001040092 | 916 | DD KAGFIQRQLVETRQITKHVARILDERENNKVDDNNKPIR--KVKIVTLKSNLVSNERKEF GFYKIREVNNY | 986 |
| WP_001040094 | 916 | DD KARFIQRQLVETRQITKHVARILDERENNELDSKGRRIR--KVKIVTLKSNLVSNERKEF GFYKIREVNNY | 986 |
| WP_001040095 | 916 | DD KARFIQRQLVETRQITKHVARILDERFNNELDSKGRRIR--KVKIVTLKSNLVSNERKEF GFYKIREVNNY | 986 |
| WP_001040096 | 916 | DD KARFIQRQLVETRQITKHVARILDERENNELDSKGRRIR--KVKIVTLKSNLVSNERKEF GFYKIREVNNY | 986 |
| WP_001040097 | 916 | DD KARFIQRQLVETRQITKHVARILDERFNNELDSKGRRIR--KVKIVILKSNLVSNERKEF GFYKIREVNNY | 986 |
| WP_001040098 | 916 | DD KARFIQRQLVETRQITKHVARILDERENNELDSKGRRIR--KVKIVTLKSNLVSNERKEF GFYKIREVNNY | 986 |
| WP_001040099 | 916 | DD KARFIQRQLVETRQITKHVARILDERFNNELDSKGRRIR--KVKIVTLKSNLVSNERKEF GFYKIREVNNY | 986 |
| WP_001040100 | 916 | DD KARFIQRQLVETRQITKHVARILDERFNNELDSKGRRIR--KVKIVTLKSNLVSNERKEF GFYKIREVNNY | 986 |
| WP_001040104 | 916 | DD KARFIQRQLVETRQITKHVARILDERFNNELDSKGRRIR--KVKIVTLKSNLVSNERKEF GFYKIREVNNY | 986 |
| WP_001040105 | 916 | DD KARFIQRQLVETRQITKHVARILDERFNNELDSKGRRIR--KVKIVTLKSNLVSNERKEF GFYKIREVNNY | 986 |
| WP_001040106 | 916 | DD KARFIQRQLVETRQITKHVARILDERFNNELDSKGRRIR--KVKIVTLKSNLVSNERKEF GFYKIREVNDY | 986 |
| WP_001040107 | 916 | DD KARFIQRQLVETRQITKHVARILDERENNELDSKGRRIR--KVKIVTLKSNLVSNERKEF GFYKIREVNDY | 986 |
| WP_001040108 | 916 | DD KARFIQRQLVETRQITKHVARILDERENNELDSKGRRIR--KVKIVTLKSNLVSNERKEF GFYKIREVNDY | 986 |
| WP_001040109 | 916 | DD KARFIQRQLVETRQITKHVARILDERENNELDSKGRRIR--KVKIVTLKSNLVSNERKEF GFYKIREVNDY | 986 |
| WP_001040110 | 916 | DD KARFIQRQLVETRQITKHVARILDERENNELDSKGRRIR--KVKIVTLKSNLVSNERKEF GFYKIREVNDY | 986 |
| WP_015058523 | 916 | DD KAGFIQRQLVETRQITKHVARILDERENNKVDDNNKPIR--KVKIVTLKSNLVSNERKEF GFYKIREVNNY | 986 |
| WP_017643650 | 916 | DD KARFIQRQLVETRQITKHVARILDERENNELDSKGRRIR--KVKIVTLKSNLVSNFRKEF GFYKIREVNNY | 986 |
| WP_017647151 | 916 | DD KARFIQRQLVETRQITKHVARILDERENNELDSKGRRIR--KVKIVTLKSNLVSNFRKEF GFYKIREVNNY | 986 |
| WP_017648376 | 916 | DD KARFIQRQLVETRQITKHVARILDERENNELDSKGRRIR--KVKIVTLKSNLVSNFRKEF GFYKIREVNNY | 986 |
| WP_017649527 | 916 | DD KARFIQRQLVETRQITKHVARILDERENNELDSKGRRIR--KVKIVTLKSNLVSNFRKEF GFYKIREVNNY | 986 |
| WP_017771611 | 916 | DD KARFIQRQLVETRQITKHVARILDERFNNELDSKGRRIR--KVKIVTLKSNLVSNFRKEF GFYKIREVNDY | 986 |
| WP_017771984 | 916 | DD KARFIQRQLVETRQITKHVARILDERFNNELDSKGRRIR--KVKIVTLKSNLVSNFRKEF GFYKIREVNNY | 986 |
| CFQ25032 | 916 | DD KARFIQRQLVETRQITKHVARILDERFNNELDSKGRRIR--KVKIVTLKSNLVSNFRKEF GFYKIREVNNY | 986 |
| CFV16040 | 916 | DD KARFIQRQLVEIRQITKHVARILDERFNNELDSKGRRIR--KVKIVTLKSNLVSNFRKEF GFYKIREVNNY | 986 |
| KLJ37842 | 916 | DD KARFIQRQLVETRQITKHVARILDERFNNELDSKGRRIR--KVKIVTVKSNLVSNFRKEF GFYKIREVNNY | 986 |
| KLJ72361 | 916 | DD KARFIQRQLVETRQITKHVARILDELFNNELDSKGRRIR--KVKIVTLKSNLVSNFRKEF GFYKIREVNNY | 986 |
| KLL20707 | 930 | DD KARFIQRQLVETRQITKHVARILDERFNNELDSKGRRIR--KVKIVTLKSNLVSNFRKEF GFYKIREVNNY | 1000 |
| KLL42645 | 916 | DD KARFIQRQLVETRQITKHVARILDERFNNELDSKGRRIR--KVKIVTLKSNLVSNERKEF GFYKIREVNDY | 986 |
| WP_047207273 | 916 | DD KARFIQRQLVETRQITKHVARILDERFNNELDSKGRRIR--KVKIVTLKSNLVSNFRKEF GFYKIREVNNY | 986 |

-continued

```
WP_047209694   916 DD KARFIQRQLVETRQITKHVARILDERFNNELDSKGRRIR--KVKIVTLKSNLVSNFRKEF GFYKIREVNNY   986
WP_050198062   916 DD KARFIQRQLVETRQITKHVARILDERFNNELDSKGRRIR--KVKIVTLKSNLVSNFRKEF GFYKIREVNNY   986
WP_050201642   916 DD KARFIQRQLVETRQITKHVASILDERFNNELDSKGRRIR--KVKIVTLKSNLVSNFRKEF GFYKIREVNNY   986
WP_050204027   916 DD KARFIQRQLVETRQITKHVARILDERFNNELDSKGRRIR--KVKIVTLKSNLVSNFRKEF GFYKIREVNDY   986
WP_050881965   916 DD KARFIQRQLVETRQITKHVARILDERENNELDSKGRRIR--KVKIVTLKSNLVSNFRKEF GFYKIREVNNY   986
WP_050886065   916 DD KARFIQRQLVETRQITKHVARILDERFNNELDSKGRRIR--KVKIVTLKSNLVSNFRKEF GFYKIREVNNY   986
AHN30376       916 DD KAGFIQRQLVETRQITKHVARILDERFNNKVDDNKPIR--KVKIVTLKSNLVSNFRKEF GFYKIREVNNY   986
EAO78426       916 DD KARFIQRQLVETRQITKHVARILDERENNELDSKGRRIR--KVKIVTLKSNLVSNFRKEF GFYKIREVNNY   986
CCW42055       916 DD KARFIQRQLVETRQITKHVARILDERFNNELDSKGRRIR--KVKIVTLKSNLVSNFRKEF GFYKIREVNDY   986
WP_003041502   910 ND KAGFIKRQLVETRQITKHVAQVLDARFNAKHDENKKVIR--DVKIITLKSNLVSQFRKDF KFYKVREINDY   980
WP_037593752   911 ED KAGFIKRQLVETRQITKHVAQILDERENTEFDGAQRRIR--NVKIITLKSNLVSNFRKEF ELYKVREINDY   981
WP_049516684   911 ED KAGFIKRQLVETRQITKHVAQILDERFNTEFDGAQRRIR--NVKIITLKSNLVSNFRKEF ELYKVREINDY   981
GAD46167       910 ED KAGFIKRQLVETRQITKHVAQILDERENTEFDGAQRRIR--NVKIITLKSNLVSNFRKEF ELYKVREINDY   980
WP_018363470   919 AD KAGFIKRQLVETRQITKHVAQILDARFNTERDENDKVIR--DVKVITLKSNLVSQFRKEF KFYKVREINDY   989
WP_003043819   920 AD KAGFIKRQLVETRQITKHVARILDSRMNTKRDKNDKPIR--EVKVITLKSKLVSDERKDE QLYKVRDINNY   990
WP_006269658   910 ED KAGFIKRQLVETRQITKHVAQILDERENTEFDGNKRRIR--NVKIITLKSNLVSNERKEF ELYKVREINDY   980
WP_048800889   910 ND KAGFIHRQLVETRQITKHVAQILDARFNPKRDDNKKVIR--DVKIITLKSNLVSQFRRDE KLYKVREINDY   980
WP_012767106   910 LD KAGFIKRQLVETRQITKHVAQILDSRMNTKYDENDKLIR--EVKVITLKSKLVSDFRKDF QFYKVREINNY   980
WP_014612333   910 LD KAGFIKRQLVETRQITKHVAQILDSRMNTKYDENDKLIR--EVKVITLKSKLVSDERKDF QFYKVREINNY   980
WP_015017095   910 LD KAGFIKRQLVETRQITKHVAQILDSRMNTKYDENDKLIR--EVKVITLKSKLVSDERKDE QFYKVREINNY   980
WP_015057649   910 LD KAGFIKRQLVETRQITKHVAQILDSRMNTKYDENDKLIR--EVKVITLKSKLVSDERKDF QFYKVREINNY   980
WP_048327215   910 LD KAGFIKRQLVETRQITKHVAQILDSRMNTKYDENDKLIR--EVKVITLKSKLVSDERKDE QFYKVREINNY   980
WP_049519324   910 LD KAGFIKRQLVETRQITKHVAQILDSRMNTKYDENDKLIR--EVKVITLKSKLVSDFRKDF QFYKVREINNY   980
WP_012515931   910 VD KAGFIQRQLVETRQITKHVAQILDSRENTEFDDHNKRIR--KVHIITLKSKLVSDFRKEF GLYKIRDINHY   980
WP_021320964   910 VD KAGFIQRQLVETRQITKHVAQILDSRENTEFDDHNKRIR--KVHIITLKSKLVSDFRKEF GLYKIRDINHY   980
WP_037581760   910 VD KAGFIQLQLVETRQITKHVAQILDSRENTEFDDHNKRIR--KVHIITLKSKLVSDFRKEF GLYKIRDINHY   980
WP_004232481   918 TD KAGFIKRQLVETRQITKHVAQILDARFNTKCDENDKVIR--DVKVITLKSSLVSQFRKEF KFYKVREINDY   988
WP_009854540   919 AD KAGFIKRQLVETRQITKHVAQILDARFNTEHDENDKVIR--DVKVITLKSNLVSQFRKDF EFYKVREINDY   989
WP_012962174   919 ND KAGFIKRQLVETRQITKHVAQILDSRENTERDENDKVIR--NVKVITLKSNLVSQFRKDF KFYKVREINDY   989
WP_039695303   921 AD KAGFIKRQLVETRQITKHVAQILDARFNTEHDENDKVIR--DVKVITLKSNLVSQFRKDF EFYKVREINDY   991
WP_014334983   918 AD KAGFIKRQLVETRQITKHVAQILDARFNTKRDENDKVIR--DVKVITLKSNLVSQFRKEF KFYKVREINDY   988
WP_003099269   911 FD KAGFIKRQLVETRQITKHVAQILDSRENSNLTEDSKSNR--NVKIITLKSKMVSDFRKDF GFYKLREVNDY   981
AHY15608       911 FD KAGFIKRQLVETRQITKHVAQILDSRENSNLTEDSKSNR--NVKIITLKSKMVSDFRKDF GFYKLREVNDY   981
AHY17476       911 FD KAGFIKRQLVETRQITKHVAQILDSRENSNLTEDSKSNR--NVKIITLKSKMVSDERKDF GFYKLREVNDY   981
ESR09100            -- ----------------------------------------------------------- -----------
AGM98575       911 FD KAGFIKRQLVETRQITKHVAQILDSRENSNLTEDSKSNR--NVKIITLKSKMVSDFRKDF GFYKLREVNDY   981
ALF27331       911 DD KAGFIKRQLVETRQITKHVARILDERENTETDENNKKIR--QVKIVTLKSNLVSNFRKEF ELYKVREINDY   981
WP_018372492   924 ED KAGFIRRQLVETRQITKHVARLLDEKLNRKKNENGEKLR--TTKIITLKSVFASRFRANF DLYKLRELNHY   994
WP_045618028   914 RD KVGFIKRQLVETRQITKHVAQILDARFNTEVTEKDKKDR--SVKIITLKSNLVSNERKEF RLYKVREINDY   984
WP_045635197   913 RD KVGFIKRQLVETRQITKHVAQILDARYNTEVNEKDKKNR--TVKIITLKSNLVSNFRKEF RLYKVRELNDY   983
WP_002263549   911 DD KAGFIKRQLVETRQITKHVARILDERENTETDENNKKIR--QVKIVTLKSNLVSNERKEF ELYKVREINDY   981
```

-continued

```
WP_002263887    911 DD KAGFIKRQLVETRQITKHVARILDERENTETDENNKKIR--QVKIVTLKSNLVSNERKEF ELYKVREINDY    981
WP_002264920    911 DD KAGFIKRQLVETRQITKHVARILDERENTETDENNKKIR--QVKIVTLKSNLVSNFRKEF ELYKVREINDY    981
WP_002269043    911 DD KAGFIKRQLVETRQITKHVARILDERFNTETDENNKKIR--QVKIVTLKSNLVSNFRKEF ELYKVREINDY    981
WP_002269448    911 DD KAGFIKRQLVETRQITKHVARILDERFYTETDENNKKIR--QVKIVTLKSNLVSNFRKEF ELYKVREINDY    981
WP_002271977    911 DD KAGFIKRQLVETRQITKHVARILDERFYTETDENNKKIR--QVKIVTLKSNLVSNFRKEF ELYKVREINDY    981
WP_002272766    911 DD KAGFIKRQLVETRQITKHVARILDERFNTETDENNKKIR--QVKIVTLKSNLVSNFRKEF ELYKVREINDY    981
WP_002273241    911 DD KAGFIKRQLVETRQITKHVARILDERFYTETDENNKKIR--QVKIVTLKSNLVSNERKEF ELYKVREINDY    981
WP_002275430    911 DD KAGFIKRQLVETRQITKHVARILDERFNTETDENNKKIR--QVKIVILKSNLVSNERKEF ELYKVREINDY    981
WP_002276448    911 DD KAGFIKRQLVETRQITKHVARILDERFYTETDENNKKIR--QVKIVTLKSNLVSNFRKEF ELYKVREINDY    981
WP_002277050    913 DD KAGFIKRQLVETRQITKHVARMLDERFNKEFDDNNKRIR--RVKIVTLKSNLVSSFRKEF ELYKVREINDY    983
WP_002277364    911 DD KAGFIKRQLVETRQITKHVARILDERFHTETDENNKKIR--QVKIVTLKSNLVSNERKEF ELYKVREINDY    981
WP_002279025    911 DD KAGFIKRQLVETRQITKHVARILDERENTETDENNKKIR--QVKIVTLKSNLVSNERKEF ELYKVREINDY    981
WP_002279859    911 DD KAGFIKRQLVETRQITKHVARILDERFNTETDENNKKIR--QVKIVTLKSNLVSNERKEF ELYKVREINDY    981
WP_002280230    911 DD KAGFIKRQLVETRQITKHVARILDERFYTETDENNKKIR--QVKIVTLKSNLVSNERKEF ELYKVREINDY    981
WP_002281696    911 DD KAGFIKRQLVETRQITKHVARILDERFHTETDENNKKIR--QVKIVTLKSNLVSNERKEF ELYKVREINDY    981
WP_002282247    913 DD KAGFIKRQLVETRQITKHVARMLDERFNKEFDDNNKRIR--RVKIVTLKSNLVSSFRKEF ELYKVREINDY    983
WP_002282906    911 DD KAGFIKRQLVETRQITKHVARILDERENTETDENNKKIR--QVKIVTLKSNLVSNFRKEF ELYKVREINDY    981
WP_002283846    911 DD KAGFIKRQLVETRQITKHVARILDERFHTETDENNKKIR--QVKIVTLKSNLVSNERKEF ELYKVREINDY    981
WP_002287255    911 DD KAGFIKRQLVETRQITKHVARILDERFHTETDENNKKIR--QVKIVILKSNLVSNERKEF ELYKVREINDY    981
WP_002288990    911 DD KAGFIKRQLVETRQITKHVARILDERENTETDENNKKIR--QVKIVTLKSNLVSNFRKEF ELYKVREINDY    981
WP_002289641    911 DD KAGFIKRQLVETRQITKHVARILDERENTETDENNKKIR--QVKIVTLKSNLVSNERKEF ELYKVREINDY    981
WP_002290427    911 DD KAGFIKRQLVETRQITKHVARILDERENTETDENNKKIR--QVKIVTLKSNLVSNERKEF ELYKVREINDY    981
WP_002295753    911 DD KAGFIKRQLVETRQITKHVARILDERFYTETDENNKKIR--QVKIVILKSNLVSNERKEF ELYKVREINDY    981
WP_002296423    911 DD KAGFIKRQLVETRQITKHVARILDERFHTETDENNKKIR--QVKIVTLKSNLVSNERKEF ELYKVREINDY    981
WP_002304487    925 DD KAGFIKRQLVETRQITKHVARILDERENTETDENNKKIR--QVKIVTLKSNLVSNERKEF ELYKVREINDY    995
WP_002305844    911 DD KAGFIKRQLVETRQITKHVARILDERFYTETDENNKKIR--QVKIVILKSNLVSNERKEF ELYKVREINDY    981
WP_002307203    911 DD KAGFIKRQLVETRQITKHVARILDERFNTETDENNKKIR--QVKIVTLKSNLVSNERKEF ELYKVREINDY    981
WP_002310390    911 DD KAGFIKHQLVETRQITKHVARILDERENTETDENNKKIR--QVKIVTLKSNLVSNERKEF ELYKVREINDY    981
WP_002352408    911 DD KAGFIKRQLVETRQITKHVARILDERENTETDENNKKIR--QVKIVTLKSNLVSNERKEF ELYKVREINDY    981
WP_012997688    911 DD KAGFIKRQLVETRQITKHVARILDERFHTETDENNKKIR--QVKIVTLKSNLVSNFRKEF ELYKVREINDY    981
WP_014677909    911 DD KAGFIKRQLVETRQITKHVARILDERFYTETDENNKKIR--QVKIVTLKSNLVSNERKEF ELYKVREINDY    981
WP_019312892    911 DD KAGFIKRQLVETRQITKHVARILDERFHTETDENNKKIR--QVKIVTLKSNLVSNFRKEF ELYKVREINDY    981
WP_019313659    911 DD KAGFIKRQLVETRQITKHVARILDERFHTETDENNKKIR--QVKIVTLKSNLVSNFRKEF ELYKVREINDY    981
WP_019314093    911 DD KAGFIKRQLVETRQITKHVARILDERENTETDENNKKIR--QVKIVTLKSNLVSNERKEF ELYKVREINDY    981
WP_019315370    911 DD KAGFIKRQLVETRQITKHVARILDERENTETDENNKKIR--QVKIVTLKSNLVSNERKEF ELYKVREINDY    981
WP_019803776    911 DD KAGFIKRQLVETRQITKHVARILDERFNTETDENNKKIR--QVKIVILKSNLVSNERKEF ELYKVREINDY    981
WP_019805234    911 DD KAGFIKRQLVETRQITKHVARILDERFNTETDENNKKIR--QVKIVTLKSNLVSNERKEF ELYKVREINDY    981
WP_024783594    911 DD KAGFIKRQLVETRQITKHVARILDERENTETDENNKKIR--QVKIVTLKSNLVSNERKEF ELYKVREINDY    981
WP_024784288    913 DD KAGFIKRQLVETRQITKHVARMLDERFNKEFDDNNKRIR--RVKIVTLKSNLVSSFRKEF ELYKVREINDY    983
WP_024784666    911 DD KAGFIKRQLVETRQITKHVARILDERFHTETDENNKKIR--QVKIVTLKSNLVSNFRKEF ELYKVREINDY    981
```

-continued

```
WP_024784894  911 DD KAGFIKRQLVETRQITKHVARILDERENTETDENNKKIR--QVKIVTLKSNLVSNERKEF ELYKVREINDY  981

WP_024786433  913 DD KAGFIKRQLVETRQITKHVARMLDERENKEFDDNNKRIR--RVKIVTLKSNLVSSFRKEF ELYKVREINDY  983

WP_049473442  911 DD KAGFIKRQLVETRQITKHVARILDERENTETDENNKKIR--QVKIVTLKSNLVSNERKEF ELYKVREINDY  981

WP_049474547  911 DD KAGFIKRQLVETRQITKHVARILDERENTETDENNKKIR--QVKIVTLKSNLVSNFRKEF ELYKVREINDY  981

EMC03581      904 DD KAGFIKRQLVETRQITKHVARILDERFHTETDENNKKIR--QVKIVTLKSNLVSNFRKEF ELYKVREINDY  974

WP_000428612  916 RD KVGFIKRQLVETRQITKHVAQILDARYNTEVNEKDKKNR--TVKIITLKSNLVSNFRKEF RLYKIREINDY  986

WP_000428613  914 RD KVGFIKRQLVETRQITKHVAQILDARFNKEVNEKDKKNR--TVKIITLKSNLVSNFRKEF RLYKVREINDY  984

WP_049523028  909 RD KVGFIKRQLVETRQITKHVAQILDDRFNAEVNEKNQKLR--SVKIITLKSNLVSNFRKEF GLYKVREINDY  979

WP_003107102  880 YD KAGFIKRQLVETRQITKHVAQILNNRENNVDDSSKNKR--PVKIITLKSKMVSDERKEF GFYKIREVNDY  950

WP_054279288  912 SD KANFIQRQLVETRQITKHVAQILDSRENTERDEKDRPIR--RVKVITLKSKFVSDFRQDE GFYKLREINDY  982

WP_049531101  914 RD KVGFIKRQLVETRQITKHVAQILDSRENTKVNEKNQKIR--TVKIITLKSNLVSNERKEF RLYKVREINDY  984

WP_049538452  914 RD KVGFIRRQLVETRQITKHVAQILDSRFNTEVTEKDKKNR--NVKIITLKSNLVSNERKEF GLYKVREINDY  984

WP_049549711  916 LD KVGFIKRQLVETRQITKHVAQILDARFNKEVTEKDKKNR--NVKIITLKSNLVSNFRKEF RLYKVREINDY  986

WP_007896501  917 SD KARFLRRQLVETRQITKHVAQLLDSRENSKSNQNKKLAR--NVKIITLKSKIVSDERKDF GLYKLREVNNY  987

EFR44625      869 SD KARFLRRQLVETRQITKHVAQLLDSRENSKSNQNKKLAR--NVKIITLKSKIVSDFRKDF GLYKLREVNNY  939

WP_002897477  913 RD KVGFIRRQLVETQQITKNVAQILDARFNTEVKEKNQKIR--TVKIITLKSNLVSNFRKEF GLYKVREINNY  983

WP_002906454  913 RD KVGFIKRQLVETRQITKHVAQLLDTRENTEVNEENQKIR--TVKIITLKSNLVSNERKEF GLYKVREINDY  983

WP_009729476  914 LD KVGFIKRQLVETRQITKHVARILDARFNKEVTEKDKKNR--TVKIITLKSNLVSNFRKEF ELYKVREINDY  984

CQR24647      913 ED KAGFIKRQLVETRQITKHVARILDERFNRDEDKNDKRIR--NVKIVTLKSNLVSNERKEF GFYKVREINNF  983

WP_000066813  918 LD KVGFIKRQLVETRQITKHVAQFLDARFNKEVTEKDKKNR--NVKIITLKSNLVSNERKEF GLYKVREINDY  988

WP_009754323  914 RD KVGFIKRQLVETRQITKHVARILDARFNTEVSEKNQKIR--SVKIITLKSNLVSNFRKEF KLYKVREINDY  984

WP_044674937  913 ED KARFIQRQLVETRQITKHVARILDTRENTKLDEAGNRIRdpKVNIITLKSNLVSQFRKDY QLYKVREINNY  985

WP_044676715  915 ED KARFIQRQLVETRQITKHVARILDTRENTKLDEAGNRIRdpKVNIITLKSNLVSQFRKDY QLYKVREINNY  987

WP_044680361  915 ED KARFIQRQLVETRQITKHVARILDTRENTKLDEAGNRIRdpKVNIITLKSNLVSQFRKDY QLYKVREINNY  987

WP_044681799  913 ED KARFIQRQLVETRQITKHVARILDTRENTKLDEAGNRIRdpKVNIITLKSNLVSQFRKDY QLYKVREINNY  985

WP_049533112  910 ND KAGFIKRQLVETRQITKHVAQVLDARFNAKHDENKKVIR--DVKIITLKSNLVSQFRKDF KFYKVREINDY  980

WP_029090905  891 RD KEGFIARQLVETRQITKHVTQLLQQEY-----------K-dTTKVFAIKATLVSGLRRKF EFIKNRNVNDY  951

WP_006506696  917 RD EERFINRQLVETRQITKNVTQIIEDHYST-------------TKVAAIRANLSHEFRVKN HIYKNRDINDY  976

AIT42264      911 LD KAGFIKRQLVETRQITKHVAQILDSRMNTKYDENDKLIR--EVKVITLKSLVSDFRKDF QFYKVREINNY  981

WP_034440723  915 RD RQQFINRQLVETRQITKHVANLLSHHLNEK-----KEVG--EINIVLLKSALTSQFRKKF DFYKVREVNDY  980

AKQ21048      911 LD KAGFIKRQLVETRQITKHVAQILDSRMNTKYDENDKLIR--EVKVITLKSLVSDFRKDF QFYKVREINNY  981

WP_004636532  916 AD RAHFLNRQLVETRQITKHVANLLDSQYNTAEEQ-----R---INIVLLKSSMTSRFRKEF KLYKVREINDY  980

WP_002364836  922 ED KAHFIQRQLVETRQITKNVAGILDQRYNANSKE-----K--KVQIITLKASLTSQFRSIF GLYKVREVNDY  987

WP_016631044  873 ED KAHFIQRQLVETRQITKNVAGILDQRYNAKSKE-----K--KVQIITLKASLTSQFRSIF GLYKVREVNDY  938

EMS75795      655 ED KARFIQRQLVETRQITKHVAAILDQYFN-QPEE-SK-NK--GIRIITLKSSLVSQFRKTF GINKVREINNH  722

WP_002373311  922 ED KAHFIQRQLVETRQITKNVAGILDQRYNAKSKE-----K--KVQIITLKASLTSQFRSIF GLYKVREVNDY  987

WP_002378009  922 ED KAHFIQRQLVETRQITKNVAGILDQRYNAKSKE-----K--KVQIITLKASLTSQFRSIF GLYKVREVNDY  987

WP_002407324  922 ED KAHFIQRQLVETRQITKNVAGILDQRYNAKSKE-----K--KVQIITLKASLTSQFRSIF GLYKVREVNDY  987

WP_002413717  922 ED KAHFIQRQLVETRQITKNVAGILNQRYNANSKE-----K--KVQIITLKASLTSQFRSIF GLYKVREVNDY  987

WP_010775580  924 ED KAHFIQRQLVETRQITKNVAGILDQRYNAKSKE-----K--KVQIITLKASLTSQFRSIF GLYKVREVNDY  989

WP_010818269  922 ED KAHFIQRQLVETRQITKNVAGILDQRYNAKSKE-----K--KVQIITLKASLTSQFRSIF GLYKVREVNDY  987
```

```
WP_010824395   922 ED KAHFIQRQLVETRQITKNVAGILDQLYNAKSKE-----K--KVQIITLKASLTSQFRSIF GLYKVREVNDY   987
WP_016622645   922 ED KAHFIQRQLVETRQITKNVAGILDQRYNAKSKE-----K--KVQIITLKASLTSQFRSIF GLYKVREVNDY   987
WP_033624816   922 ED KAHFIQRQLVETRQITKNVAGILDQRYNAKSKE-----K--KVQIITLKASLTSQFRSIF GLYKVREVNDY   987
WP_033625576   922 ED KAHFIQRQLVETRQITKNVAGILDQRYNAKSKE-----K--KVQIITLKASLTSQFRSIF GLYKVREVNDY   987
WP_033789179   922 ED KAHFIQRQLVETRQITKNVAGILDQRYNAKSKE-----K--KVQIITLKASLTSQFRSIF GLYKVREVNDY   987
WP_002310644   919 ED KAGFIKRQLVETRQITKHVAGILHHRFN-KAEDTNEPIR--KVRIITLKSALVSQFRNRF GIYKVREINEY   988
WP_002312694   920 ED KAGFIKRQLVETRQITKHVAGILHHREN-KAEDTNDPIR--KVRIITLKSALVSQFRNRF GIYKVREINEY   989
WP_002314015   920 ED KAGFIKRQLVETRQITKHVAGILHHREN-KAEDTNEPIR--KVRIITLKSALVSQFRNRF GIYKVREINEY   989
WP_002320716   920 ED KAGFIKRQLVETRQITKHVAGILHHREN-KAEDTNEPIR--KVRIITLKSALVSQFRNRF GIYKVREINEY   989
WP_002330729   919 ED KAGFIKRQLVETRQITKHVAGILHHRFN-KAEDTNEPIR--KVRIITLKSALVSQFRNRF GIYKVREINEY   988
WP_002335161   920 ED KAGFIKRQLVETRQITKHVAGILHHRFN-KAEDTNEPIR--KVRIITLKSALVSQFRNRF GIYKVREINEY   989
WP_002345439   920 ED KAGFIKRQLVETRQITKHVAGILHHRFN-KAEDTNEPIR--KVRIITLKSALVSQFRNRF GIYKVREINEY   989
WP_034867970   911 ED KARFIQRQLVETRQITKHVANILHQSFN-QEEEGTD-CD--GVQIITLKATLTSQFRQTF GLYKVREINPH   979
WP_047937432   920 ED KAGFIKRQLVETRQITKHVAGILHHREN-KAEDTNEPIR--KVRIITLKSALVSQFRNRF GIYKVREINEY   989
WP_010720994   911 ED KARFIQRQLVETRQITKHVANILHQSFN-QEEEGTD-CD--GVQIITLKATLTSQFRQTF GLYKVREINPH   979
WP_010737004   911 ED KARFIQRQLVETRQITKHVANILHQSFN-QEEEGTD-CD--GVQIITLKATLTSQFRQTF GLYKVREINPH   979
WP_034700478   911 ED KARFIQRQLVETRQITKHVANILHQSFN-QEEEGTD-CD--GVQIITLKATLTSQFRQTF GLYKVREINPH   979
WP_007209003   912 SD KAGFLKRQLVETRQITKHVATILDSKFNE--DSNNRDVQ-----IITLKSALVSEFRKTF NLYKVREINDL   977
WP_023519017   905 AD KARFIQRQLVETRQITKHVANLLHQHFN-LPEEVSA-TE--KTSIITLKSTLTSQFRQMF DIYKVREINHH   973
WP_010770040   915 DD RAHFIKRQLVETRQITKHVARILDQRFNSQKDEEGKTIR--AVRVVTLKSSLTSQFRKQF AIHKVREINDY   985
WP_048604708   912 DD KAGFIHRQLVETRQITKNVARILHQRENSEKDEEGNLIR--KVRIITLKSALTSQFRKNY GIYKIREINDY   982
WP_010750235   914 DD KARFIQRQLVETRQITKHVAAILHQYFN-QTQELEK-EK--DIRIITLKSSLVSQFRQVF GIHKVREINHH   982
AII16583       950 LD KAGFIKRQLVETRQITKHVAQILDSRMNTKYDENDKLIR--EVKVITLKSKLVSDFRKDF QFYKVREINNY  1020
WP_029073316   928 KD KERFINRQIVETRQITKHVAQIISNHYET------------TKVVTVRADLSHAFRERY HIYKNRDINDF   987
WP_031589969   928 KD QERFINRQIVETRQITKHVAQIIDNHYEN------------TKVVTVRADLSHQFRERY HIYKNRDINDE   987
KDA45870       903 KL KERFIERQLVETRQITKYVAQLLDQRLN--YDGNGVELD-eKIAIVILKAQLASQFRSEF KLRKVRALNNL   972
WP_039099354   924 -D MKGFINRQLVETRQVIKLATNLLMEQYGED----------NIELITVKSGLTHQMRTEF DFPKNRNLNNH   990
AKP02966       926 KD KLGFIHRQLVQTSQMVKGVANILNSMYK---NQGTTCIQ--------ARANLSTAFRKAL ELVKNRNINDF   999
WP_010991369   914 AD KARFIHRQLVETRQITKNVANILHQRFNYEKDDHGNTMK--QVRIVTLKSALVSQFRKQF QLYKVRDVNDY   984
WP_033838504   914 AD KARFIHRQLVETRQITKNVANILHQRFNYEKDDHGNTMK--QVRIVTLKSALVSQFRKQF QLYKVRDVNDY   984
EHN60060       917 AD KARFIHRQLVETRQITKNVANILHQRFNYEKDDHGNTMK--QVRIVTLKSALVSQFRKQF QLYKVRDVNDY   987
EFR89594       683 AD KARFIHRQLVETRQITKNVANILHQRFNYGKDDHGNTMK--QVRIVTLKSALVSQFRKQF QLYKVRGVNDY   753
WP_038409211   914 AD KANFIQRQLVETRQITKNVANILYQRFNCKQDENGNEVE--QVRIVTLKSTLVSQFRKQF QLYKVREVNDY   984
EFR95520       533 AD KANFIQRQLVETRQITKNVANILYQRFNCKQDENGNEVE--QVRIVILKSTLVSQFRKQF QLYKVREVNDY   603
WP_003723650   914 AD KARFIHRQLVETRQITKNVANILYQRFNKETDNHGNTME--QVRIVTLKSALVSQFRKQF QLYKVREVNGY   984
WP_003727705   914 AD KARFIHRQLVETRQITKNVANILHQRENKETDNHGNTME--QVRIVTLKSALVSQFRKQF QLYKVREVNDY   984
WP_003730785   914 AD KARFIHRQLVETRQITKNVANILHQRENKETDNHGNTME--QVRIVTLKSALVSQFRKQF QLYKVREVNDY   984
WP_003733029   914 AD KARFIHRQLVETRQITKNVANILHQRFNYKTDGNKDTME--TVRIVTLKSALVSQFRKQF QFYKVREVNDY   984
WP_003739838   914 AD KATFIHRQLVETRQITKNVANILHQRENNETDNHGNNME--QVRIVMLKSALVSQFRKQF QLYKVREVNDY   984
WP_014601172   914 AD KARFIHRQLVETRQITKNVANILHQRENNETDNHGNTME--QVRIVTLKSALVSQFRKQF QLYKVREVNDY   984
```

```
WP_023548323    914 AD KARFIHRQLVETRQITKNVANILHQRFNYKTDDNEDTME--PVRIVTLKSALVSQFRKQF QLYKVREVNDY     984
WP_031665337    914 AD KARFIHRQLVETRQITKNVANILHQRENKETDNHGNTME--QVRIVTLKSALVSQFRKQF QLYKVREVNDY     984
WP_031669209    914 AD KARFIHRQLVETRQITKNVANILHQRFNYKTDGNKDTME--TVRIVTLKSALVSQFRKQF QFYKVREVNDY     984
WP_033920898    914 AD KARFIHRQLVETRQITKNVANILHQRFNYKTDDNEDTME--PVRIVTLKSALVSQFRKQF QLYKVREVNDY     984
AKI42028        917 AD KARFIHRQLVETRQITKNVANILHQRFNNETDNHGNTME--QVRIVTLKSALVSQFRKQF QLYKVREVNDY     987
AKI50529        917 AD KARFIHRQLVETRQITKNVANILHQRFNYKTDDNEDTME--PVRIVTLKSALVSQFRKQF QLYKVREVNDY     987
EFR83390        362 AD KARFIHRQLVETRQITKNVANILHQRENNETDNHGNTME--QVRIVTLKSALVSQFRKQF QLYKVREVNDY     432
WP_046323366    914 AD KARFIHRQLVETRQITKNVANILHQRFNCKKDESGNVIE--QVRIVILKAALVSQFRKQF QLYKVREVNDY     984
AKE81011        927 LD KAGFIKRQLVETRQITKHVAQILDSRMNTKYDENDKLIR--EVKVITLKSKLVSDERKDF QFYKVREINNY     997
CUO82355        921 RD EERFINRQLVETRQITKNVTQIIEDHYST------------TKVAAIRANLSHEFRVKN HIYKNRDINDY     980
WP_033162887    923 KD KERFINRQLVETRQIIKNVAVIINDHYTN------------TNIVTVRAELSHQFRERY KIYKNRDINDF     982
AGZ01981        944 LD KAGFIKRQLVETRQITKHVAQILDSRMNTKYDENDKLIR--EVKVITLKSKLVSDERKDF QFYKVREINNY    1014
AKA60242        911 LD KAGFIKRQLVETRQITKHVAQILDSRMNTKYDENDKLIR--EVKVITLKSKLVSDERKDF QFYKVREINNY     981
AKS40380        911 LD KAGFIKRQLVETRQITKHVAQILDSRMNTKYDENDKLIR--EVKVITLKSKLVSDERKDF QFYKVREINNY     981
4UN5_B          915 LD KAGFIKRQLVETRQITKHVAQILDSRMNTKYDENDKLIR--EVKVITLKSKLVSDERKDF QFYKVREINNY     985
WP_010922251    982 HHAHDAYLNAVVGTALIKKYPKL-ESEFVYGDYKVYDV  S---EQEi--GK  ATAKY--F-FYSNIM-NFFKTEIT 1051
WP_039695303    992 HHAHDAYLNAVVGTALLKKYPKL-ASEFVYGEYKKYDI  S---SD------  KATAK--YfFYSNLM-NFFKTKVK 1058
WP_045635197    984 HHAHDAYLNAVVAKAILKKYPKL-EPEFVYGEYQKYDL  SkdpKEV---EK ATEKY--F-FYSNLL-NFFKEEVH 1055
5AXW_A          703 HHAEDALI--------------IaNADFIFKEWKKLDK  Nq-mFE----EK ETEQEykEiFITPHQiKHIKDFKD  771
WP_009880683    666 HHAHDAYLNAVVGTALIKKYPKL-ESEFVYGDYKVYDI  S---EQEi--GK ATAKY--F-FYSNIM-NFFKTEIT  735
WP_010922251    982 HHAHDAYLNAVVGTALIKKYPKL-ESEFVYGDYKVYDV  S---EQEi--GK ATAKY--F-FYSNIM-NFFKTEIT 1051
WP_011054416    982 HHAHDAYLNAVVGTALIKKYPKL-ESEFVYGDYKVYDV  S---EQEi--GK ATAKY--F-FYSNIM-NFFKTEIT 1051
WP_011284745    982 HHAHDAYLNAVVGTALIKKYPKL-ESEFVYGDYKVYDV  S---EQEi--GK ATAKY--F-FYSNIM-NFFKTEIT 1051
WP_011285506    982 HHAHDAYLNAVVGTALIKKYPKL-ESEFVYGDYKVYDV  S---EQEi--GK ATAKY--F-FYSNIM-NFFKTEIT 1051
WP_011527619    982 HHAHDAYLNAVVGTALIKKYPKL-ESEFVYGDYKVYDV  S---EQEi--GK ATAKY--F-FYSNIM-NFFKTEIT 1051
WP_012560673    982 HHAHDAYLNAVVGTALIKKYPKL-ESEFVYGDYKVYDI  S---EQEi--GK ATAKY--F-FYSNIM-NFFKTEIT 1051
WP_014407541    981 HHAHDAYLNAVVGTALIKKYPKL-ESEFVYGDYKVYDV  S---EQEi--GK ATAKY--F-FYSNIM-NFFKTEIT 1050
WP_020905136    982 HHAHDAYLNAVVGTALIKKYPKL-ESEFVYGDYKVYDV  S---EQEi--GK ATAKY--F-FYSNIM-NFFKTEIT 1051
WP_023080005    981 HHAHDAYLNAVVGTALIKKYPKL-ESEFVYGDYKVYDV  S---EQEi--GK ATAKY--F-FYSNIM-NFFKTEIT 1050
WP_023610282    981 HHAHDAYLNAVVGTALIKKYPKL-ESEFVYGDYKVYDV  S---EQEi--GK ATAKY--F-FYSNIM-NFFKTEIT 1050
WP_030125963    982 HHAHDAYLNAVVGTALIKKYPKL-ESEFVYGDYKVYDV  S---EQEi--GK ATAKY--F-FYSNIM-NFFKTEIT 1051
WP_030126706    982 HHAHDAYLNAVVGTALIKKYPKL-ESEFVYGDYKVYDV  S---EQEi--GK ATAKY--F-FYSNIM-NFFKTEIT 1051
WP_031488318    982 HHAHDAYLNAVVGTALIKKYPKL-ESEFVYGDYKVYDV  S---EQEi--GK ATAKY--F-FYSNIM-NFFKTEIT 1051
WP_032460140    982 HHAHDAYLNAVVGTALIKKYPKL-ESEFVYGDYKVYDI  S---EQEi--GK ATAKY--F-FYSNIM-NFFKTEIT 1051
WP_032461047    982 HHAHDAYLNAVVGTALIKKYPKL-ESEFVYGDYKVYDI  S---EQEi--GK ATAKY--F-FYSNIM-NFFKTEIT 1051
WP_032462016    982 HHAHDAYLNAVVGTALIKKYPKL-ESEFVYGDYKVYDV  S---EQEi--GK ATAKY--F-FYSNIM-NFFKTEIT 1051
WP_032462936    982 HHAHDAYLNAVVGTALIKKYPKL-ESEFVYGDYKVYDV  S---EQEi--GK ATAKY--F-FYSNIM-NFFKTEIT 1051
WP_032464890    982 HHAHDAYLNAVVGTALIKKYPKL-ESEFVYGDYKVYDV  S---EQEi--GK ATAKY--F-FYSNIM-NFFKTEIT 1051
WP_033888930    807 HHAHDAYLNAVVGTALIKKYPKL-ESEFVYGDYKVYDV  S---EQEi--GK ATAKY--F-FYSNIM-NFFKTEIT  876
WP_038431314    982 HHAHDAYLNAVVGTALIKKYPKL-ESEFVYGDYKVYDV  S---EQEi--GK ATAKY--F-FYSNIM-NFFKTEIT 1051
```

-continued

```
WP_038432938   981 HHAHDAYLNAVVGTALIKKYPKL-ESEFVYGDYKVYDV S---EQEi--GK ATAKY--F-FYSNIM-NFFKTEIT 1050
WP_038434062   982 HHAHDAYLNAVVGTALIKKYPKL-ESEFVYGDYKVYDV S---EQEi--GK ATAKY--F-FYSNIM-NFFKTEIT 1051
BAQ51233       893 HHAHDAYLNAVVGTALIKKYPKL-ESEFVYGDYKVYDV S---EQEi--GK ATAKY--F-FYSNIM-NFFKTEIT  962
KGE60162       157 HHAHDAYLNAVVGTALIKKYPKL-ESEFVYGDYKVYDV S---EQEi--GK ATAKY--F-FYSNIM-NFFKTEIT  226
KGE60856           -------------------------------------- ------------ -----------------------
WP_002989955   982 HHAHDAYLNAVVGTALIKKYPKL-ESEFVYGDYKVYDV S---EQEi--GK ATAKY--F-FYSNIM-NFFKTEIT 1051
WP_003030002   981 HHAHDAYLNAVVGNALLLKYPQL-EPEFVYGEYPKYN- S---YR---SRK SATEK--FlFYSNIL-RFFKKE-- 1041
WP_003065552   992 HHAHDAYLNAVVGTALLKKYPKL-ASEFVYGEYKKYDI S---SD------ KATAK--YfFYSNLM-NFFKRVIR 1058
WP_001040076   987 HHAHDAYLNAVVAKAILTKYPQL-EPEFVYGDYPKYN- S---YKT---RK ATEKL--F-FYSNIM-NFFKTKVT 1049
WP_001040078   987 HHAHDAYLNAVVAKAILTKYPQL-EPEFVYGLYRRKK- L---SKI---VR ATRKM--F-FYSNLM-NMFKRVVR 1057
WP_001040080   987 HHAHDAYLNAVVAKAILTKYPQL-EPEFVYGDYPKYN- S---YKT---RK ATEKL--F-FYSNIM-NFFKTKVT 1049
WP_001040081   987 HHAHDAYLNAVVAKAILTKYPQL-EPEFVYGDYPKYN- S---YKT---RK ATEKL--F-FYSNIM-NFFKTKVT 1049
WP_001040083   987 HHAHDAYLNAVVAKAILTKYPQL-EPEFVYGDYPKYN- S---YKT---RK ATEKL--F-FYSNIM-NFFKTKVT 1049
WP_001040085   987 HHAHDAYLNAVVAKAILTKYPQL-EPEFVYGDYPKYN- S---YKT---RK ATEKL--F-FYSNIM-NFFKTKVT 1049
WP_001040087   987 HHAHDAYLNAVVAKAILTKYPQL-EPEFVYGDYPKYN- S---YKT---RK ATEKL--F-FYSNIM-NFFKTKVT 1049
WP_001040088   987 HHAHDAYLNAVVAKAILTKYPQL-EPEFVYGDYPKYN- S---YKT---RK ATEKL--F-FYSNIM-NFFKTKVT 1049
WP_001040089   987 HHAHDAYLNAVVAKAILTKYPQL-EPEFVYGDYPKYN- S---YKT---RK ATEKL--F-FYSNIM-NFFKTKVT 1049
WP_001040090   987 HHAHDAYLNAVVAKAILTKYPQL-EPEFVYGDYPKYN- S---YKT---RK ATEKL--F-FYSNIM-NFFKTKVT 1049
WP_001040091   987 HHAHDAYLNAVVAKAILTKYPQL-EPEFVYGDYPKYN- S---YKT---RK ATEKL--F-FYSNIM-NFFKTKVT 1049
WP_001040091   987 HHAHDAYLNAVVAKAILTKYPQL-EPEFVYGDYPKYN- S---YKT---RK ATEKL--F-FYSNIM-NFFKTKVT 1049
WP_001040094   987 HHAHDAYLNAVVAKAILTKYPQL-EPEFVYGDYPKYN- S---YKT---RK ATEKL--F-FYSNIM-NFFKTKVT 1049
WP_001040095   987 HHAHDAYLNAVVAKAILTKYPQL-EPEFVYGDYPKYN- S---YKT---RK ATEKL--F-FYSNIM-NFFKTKVT 1049
WP_001040096   987 HHAHDAYLNAVVAKAILTKYPQL-EPEFVYGDYPKYN- S---YKT---RK ATEKL--F-FYSNIM-NFFKTKVT 1049
WP_001040097   987 HHAHDAYLNAVVAKAILTKYPQL-EPEFVYGDYPKYN- S---YKT---RK ATEKL--F-FYSNIM-NFFKTKVT 1049
WP_001040098   987 HHAHDAYLNAVVAKAILTKYPQL-EPEFVYGDYPKYN- S---YKT---RK ATEKL--F-FYSNIM-NFFKTKVT 1049
WP_001040099   987 HHAHDAYLNAVVAKAILTKYPQL-EPEFVYGDYPKYN- S---YKT---RK ATEKL--F-FYSNIM-NFFKTKVT 1049
WP_001040100   987 HHAHDAYLNAVVAKAILTKYPQL-EPEFVYGDYPKYN- S---YKT---RK ATEKL--F-FYSNIM-NFFKTKVT 1049
WP_001040104   987 HHAHDAYLNAVVAKAILTKYPQL-EPEFVYGDYPKYN- S---YKT---RK ATEKL--F-FYSNIM-NFFKTKVT 1049
WP_001040105   987 HHAHDAYLNAVVAKAILTKYPQL-EPEFVYGDYPKYN- S---YKT---RK ATEKL--F-FYSNIM-NFFKTKVT 1049
WP_001040106   987 HHAHDAYLNAVVAKAILTKYPQL-EPEFVYGDYPKYN- S---YKT---RK ATEKL--F-FYSNIM-NFFKTKVT 1049
WP_001040107   987 HHAHDAYLNAVVAKAILTKYPQL-EPEFVYGDYPKYN- S---YKT---RK ATEKL--F-FYSNIM-NFFKTKVT 1049
WP_001040108   987 HHAHDAYLNAVVAKAILTKYPQL-EPEFVYGDYPKYN- S---YKT---RK ATEKL--F-FYSNIM-NFFKTKVT 1049
WP_001040109   987 HHAHDAYLNAVVAKAILTKYPQL-EPEFVYGDYPKYN- S---YKT---RK ATEKL--F-FYSNIM-NFFKTKVT 1049
WP_001040110   987 HHAHDAYLNAVVAKAILTKYPQL-EPEFVYGDYPKYN- S---YKT---RK ATEKL--F-FYSNIM-NFFKTKVT 1049
WP_015058523   987 HHAHDAYLNAVVAKAILTKYPQL-EPEFVYGDYPKYN- S---YKT---RK ATEKL--F-FYSNIM-NFFKTKVT 1049
WP_017643650   987 HHAHDAYLNAVVAKAILTKYPQL-EPEFVYGDYPKYN- S---YKT---RK ATEKL--F-FYSNIM-NFFKTKVT 1049
WP_017647151   987 HHAHDAYLNAVVAKAILTKYPQL-EPEFVYGDYPKYN- S---YKT---RK ATEKL--F-FYSNIM-NFFKTKVT 1049
WP_017648376   987 HHAHDAYLNAVVAKAILTKYPQL-EPEFVYGDYPKYN- S---YKT---RK ATEKL--F-FYSNIM-NFFKTKVT 1049
WP_017649527   987 HHAHDAYLNAVVAKAILTKYPQL-EPEFVYGDYPKYN- S---YKT---RK ATEKL--F-FYSNIM-NFFKTKVT 1049
WP_017771611   987 HHAHDAYLNAVVAKAILTKYPQL-EPEFVYGDYPKYN- S---YKT---RK ATEKL--F-FYSNIM-NFFKTKVT 1049
WP_017771984   987 HHAHDAYLNAVVAKAILTKYPQL-EPEFVYGDYPKYN- S---YKT---RK ATEKL--F-FYSNIM-NFFKTKVT 1049
```

-continued

| | | | | |
|---|---|---|---|---|
| CFQ25032 | 987 | HHAHDAYLNAVVAKAILTKYPQL-EPEFVYGDYPKYN- S---YKT---RK ATEKL--F-FYSNIM-NFFKTKVT | 1049 |
| CFV16040 | 987 | HHAHDAYLNAVVAKAILTKYPQL-EPEFVYGDYPKYN- S---YKT---RK ATEKL--F-FYSNIM-NFFKTKVT | 1049 |
| KLJ37842 | 987 | HHAHDAYLNAVVAKAILTKYPQL-EPEFVYGDYPKYN- S---YKT---RK ATEKL--F-FYSNIM-NFFKTKVT | 1049 |
| KLJ72361 | 987 | HHAHDAYLNAVVAKAILTKYPQL-EPEFVYGDYPKYN- S---YKT---RK ATEKL--F-FYSNIM-NFFKTKVT | 1049 |
| KLL20707 | 987 | HHAHDAYLNAVVAKAILTKYPQL-EPEFVYGDYPKYN- S---YKT---RK ATEKL--F-FYSNIM-NFFKTKVT | 1049 |
| KLL42645 | 987 | HHAHDAYLNAVVAKAILTKYPQL-EPEFVYGDYPKYN- S---YKT---RK ATEKL--F-FYSNIM-NFFKTKVT | 1049 |
| WP_047207273 | 987 | HHAHDAYLNAVVAKAILTKYPQL-EPEFVYGDYPKYN- S---YKT---RK ATEKL--F-FYSNIM-NFFKTKVT | 1049 |
| WP_047209694 | 987 | HHAHDAYLNAVVAKAILTKYPQL-EPEFVYGDYPKYN- S---YKT---RK ATEKL--F-FYSNIM-NFFKTKVT | 1049 |
| WP_050198062 | 987 | HHAHDAYLNAVVAKAILTKYPQL-EPEFVYGDYPKYN- S---YKT---RK ATEKL--F-FYSNIM-NFFKTKVT | 1049 |
| WP_050201642 | 987 | HHAHDAYLNAVVAKAILTKYPQL-EPEFVYGDYPKYN- S---YKT---RK ATEKL--F-FYSNIM-NFFKTKVT | 1049 |
| WP_050204027 | 987 | HHAHDAYLNAVVAKAILTKYPQL-EPEFVYGDYPKYN- S---YKT---RK ATEKL--F-FYSNIM-NFFKTKVT | 1049 |
| WP_050881965 | 987 | HHAHDAYLNAVVAKAILTKYPQL-EPEFVYGDYPKYN- S---YKT---RK ATEKL--F-FYSNIM-NFFKTKVT | 1049 |
| WP_050886065 | 987 | HHAHDAYLNAVVAKAILTKYPQL-EPEFVYGDYPKYN- S---YKT---RK ATEKL--F-FYSNIM-NFFKTKVT | 1049 |
| AHN30376 | 987 | HHAHDAYLNAVVAKAILTKYPQL-EPEFVYGDYPKYN- S---YKT---RK ATEKL--F-FYSNIM-NFFKTKVT | 1049 |
| EAO78426 | 987 | HHAHDAYLNAVVAKAILTKYPQL-EPEFVYGDYPKYN- S---YKT---RK ATEKL--F-FYSNIM-NFFKTKVT | 1049 |
| CCW42055 | 987 | HHAHDAYLNAVVAKAILTKYPQL-EPEFVYGDYPKYN- S---YKT---RK ATEKL--F-FYSNIM-NFFKTKVT | 1049 |
| WP_003041502 | 981 | HHAHDAYLNAVIGTALLKKYPKL-ASEFVYGEFKKYDV S---DK---eIG KATAK--YfFYSNLM-NFFKKEVK | 1050 |
| WP_037593752 | 982 | HHAHDAYLNAVVGNALLLKYPQL-EPEFVYGEYPKYN- S---YR---sRK SATEK--FlFYSNIL-RFFKKE-- | 1042 |
| WP_049516684 | 982 | HHAHDAYLNAVVGNALLLKYPQL-EPEFVYGEYPKYN- S---YR---sRK SATEK--FlFYSNIL-RFFKKE-- | 1042 |
| GAD46167 | 981 | HHAHDAYLNAVVGNALLLKYPQL-EPEFVYGEYPKYN- S---YR---sRK SATEK--FlFYSNIL-RFFKKE-- | 1041 |
| WP_018363470 | 990 | HHAHDAYLNAVVGTALLKKYPKL-APEFVYGEYKKYDV S---SDDhseMG KATAK--YfFYSNLM-NFFKRVIR | 1062 |
| WP_003043819 | 991 | HHAHDAYLNAVVGTALIKKYPKL-ESEFVYGDYKKYDV S---EQEi--GK ATAKR--F-FYSNIM-NFFKTEVK | 1060 |
| WP_006269658 | 981 | HHAHDAYLNAVVGNALLLKYPQL-EPEFVYGEYPKYN- S---YR---sRK SATEK--FlFYSNIL-RFFKKE-- | 1041 |
| WP_048800889 | 981 | HHAHDAYLNAVVGTALLKKYPKL-TSEFVYGEYKKYDV S---DND--eIG KATAK--YfFYSNLM-NFFKTEVK | 1051 |
| WP_012767106 | 981 | HHAHDAYLNAVVGTALIKKYTKL-ESEFVYGDYKVYDV S---EQEi--GK ATAKR--F-FYSNIM-NFFKTEIT | 1050 |
| WP_014612333 | 981 | HHAHDAYLNAVVGTALIKKYPKL-ESEFVYGDYKVYDV S---EQEi--GK ATAKR--F-FYSNIM-NFFKTEIT | 1050 |
| WP_015017095 | 981 | HHAHDAYLNAVVGTALIKKYPKL-ESEFVYGDYKVYDV S---EQEi--GK ATAKR--F-FYSNIM-NFFKTEIT | 1050 |
| WP_015057649 | 981 | HHAHDAYLNAVVGTALIKKYPKL-ESEFVYGDYKVYDV S---EQEi--GK ATAKR--F-FYSNIM-NFFKTEIT | 1050 |
| WP_048327215 | 981 | HHAHDAYLNAVVGTALIKKYPKL-ESEFVYGDYKVYDV S---EQEi--GK ATAKR--F-FYSNIM-NFFKTEIT | 1050 |
| WP_049519324 | 981 | HHAHDAYLNAVVGTALIKKYPKL-ESEFVYGDYKVYDV S---EQEi--GK ATAKR--F-FYSNIM-NFFKTEIT | 1050 |
| WP_012515931 | 981 | HHAHDAYLNAVVAKAILGKYPQL-APEFVYGDYPKYN- S---FKEr--QK ATQKM--L-FYSNIL-KFFKDQES | 1043 |
| WP_021320964 | 981 | HHAHDAYLNAVVAKAILGKYPQL-APEFVYGDYPKYN- S---FKEr--QK ATQKT--L-FYSNIL-KFFKDQES | 1043 |
| WP_037581760 | 981 | HHAHDAYLNAVVAKAILGKYPQL-APEFVYGDYPKYN- S---FKEr--QK ATQKT--L-FYSNIL-KFFKDQES | 1043 |
| WP_004232481 | 989 | HHAHDAYLNAVVGTALLKKYPKL-APEFVYGEYKKYDV S---SDNhseLG KATAK--YfFYSNLM-NFFKTEVK | 1061 |
| WP_009854540 | 990 | HHAHDAYLNAVVGTALLKKYPKL-ASEFVYGEYKKYDI S---SD------ KATAK--YfFYSNLM-NFFKTKVK | 1056 |
| WP_012962174 | 990 | HHAHDAYLNAVVGTALLKKYPKL-APEFVYGEYKKYDI S---GD------ KATAK--YfFYSNLM-NFFKRVIR | 1056 |
| WP_039695303 | 992 | HHAHDAYLNAVVGTALLKKYPKL-ASEFVYGEYKKYDI S---SD------ KATAK--YfFYSNLM-NFFKTKVK | 1058 |
| WP_014334983 | 989 | HHAHDAYLNAVVGTALLKKYPKL-TPEFVYGEYKKYDV S---SDDyseMG KATAK--YfFYSNLM-NFFKTEVK | 1061 |
| WP_003099269 | 982 | HHAQDAYLNAVVGTALLKKYPKL-EAEFVYGDYKHYDL P---DSSl--GK ATTRM--F-FYSNLM-NFFKKEIK | 1051 |
| AHY15608 | 982 | HHAQDAYLNAVVGTALLKKYPKL-EAEFVYGDYKHYDL P---DSSl--GK ATTRM--F-FYSNLM-NFFKKEIK | 1051 |

-continued

```
AHY17476         982 HHAQDAYLNAVVGTALLKKYPKL-EAEFVYGDYKHYDL P---DSSl--GK ATTRM--F-FYSNLM-NFFKKEIK 1051

ESR09100             ------------------------------------ ------------------------------------

AGM98575         982 HHAQDAYLNAVVGTALLKKYPKL-EAEFVYGDYKHYDL P---DSSl--GK ATTRM--F-FYSNLM-NFFKKEIK 1051

ALF27331         982 HHAHDAYLNAVIGKALLGVYPQL-EPEFVYGDYPHFH- G---HK---eNK ATAKK--F-FYSNIM-NFFKKD-- 1041

WP_018372492     995 HHAHDAYLNAVVAQALLKVYPKF-ERELVYGSYVKESI ----FS----RK ATERM---rMYNNIL-KFISKD-- 1055

WP_045618028     985 HHAHDPYLNAVVAKAILKKYPKL-EPEFVYGDYQKYDL TkdpKEV---EK ATEKY--F-FYSNLL-NFFKEEVH 1056

WP_045635197     984 HHAHDAYLNAVVAKAILKKYPKL-EPEFVYGEYQKYDL SkdpKEV---EK ATEKY--F-FYSNLL-NFFKEEVH 1055

WP_002263549     982 HHAHDAYLNAVIGKALLGVYPQL-EPEFVYGDYPHFH- G---HK---eNK ATAKK--F-FYSNIM-NFFKKD-- 1041

WP_002263887     982 HHAHDAYLNAVIGKALLGVYPQL-EPEFVYGDYPHFH- G---HK---eNK ATAKK--F-FYSNIM-NFFKKD-- 1041

WP_002264920     982 HHAHDAYLNAVIGKALLGVYPQL-EPEFVYGDYPHFH- G---HK---eNK ATAKK--F-FYSNIM-NFFKKD-- 1041

WP_002269043     982 HHAHDAYLNAVIGKALLGVYPQL-EPEFVYGDYPHFH- G---HK---eNK ATAKK--F-FYSNIM-NFFKKD-- 1041

WP_002269448     982 HHAHDAYLNAVIGKALLGVYPQL-EPEFVYGDYPHFH- G---HK---eNK ATAKK--F-FYSNIM-NFFKKD-- 1041

WP_002271977     982 HHAHDAYLNAVIGKALLGVYPQL-EPEFVYGDYPHFH- G---HK---eNK ATAKK--F-FYSNIM-NFFKKD-- 1041

WP_002272766     982 HHAHDAYLNAVIGKALLGVYPQL-EPEFVYGDYPHFH- G---HE---eNK ATAKK--F-FYSNIM-NFFKKD-- 1041

WP_002273241     982 HHAHDAYLNAVIGKALLGVYPQL-EPEFVYGDYPHFH- G---HK---eNK ATAKK--F-FYSNIM-NFFKKD-- 1041

WP_002275430     982 HHAHDAYLNAVIGKALLGVYPQL-EPEFVYGDYPHFH- G---HE---eNK ATAKK--F-FYSNIM-NFFKKD-- 1041

WP_002276448     982 HHAHDAYLNAVIGKALLGVYPQL-EPEFVYGDYPHFH- G---HK---eNK ATAKK--F-FYSNIM-NFFKKD-- 1041

WP_002277050     984 HHAHDAYLNAVVKALLVKYPKL-EPEFVYGEYPKYN- S---YR---eRK ATQKM--F-FYSNIM-NMFKSKVK 1046

WP_002277364     982 HHAHDAYLNAVIGKALLGVYPQL-EPEFVYGDYPHFH- G---HK---eNK ATAKK--F-FYSNIM-NFFKKD-- 1041

WP_002279025     982 HHAHDAYLNAVIGKALLGVYPQL-EPEFVYGDYPHFH- G---HE---eNK ATAKK--F-FYSNIM-NFFKKD-- 1041

WP_002279859     982 HHAHDAYLNAVIGKALLGVYPQL-EPEFVYGDYPHFH- G---HK---eNK ATAKK--F-FYSNIM-NFFKKD-- 1041

WP_002280230     982 HHAHDAYLNAVIGKALLGVYPQL-EPEFVYGDYPHFH- G---HK---eNK ATAKK--F-FYSNIM-NFFKKD-- 1041

WP_002281696     982 HHAHDAYLNAVIGKALLGVYPQL-EPEFVYGDYPHFH- G---HK---eNK ATAKK--F-FYSNIM-NFFKKD-- 1041

WP_002282247     984 HHAHDAYLNAVVKALLVKYPKL-EPEFVYGEYPKYN- S---YR---eRK ATQKM--F-FYSNIM-NMFKSKVK 1046

WP_002282906     982 HHAHDAYLNAVIGKALLGVYPQL-EPEFVYGDYPHFH- G---HK---eNK ATAKK--F-FYSNIM-NFFKKD-- 1041

WP_002283846     982 HHAHDAYLNAVIGKALLGVYPQL-EPEFVYGDYPHFH- G---HK---eNK ATAKK--F-FYSNIM-NFFKKD-- 1041

WP_002287255     982 HHTHDAYLNAVIGKALLGVYPQL-EPEFVYGDYPHFH- G---HK---eNK ATAKK--F-FYSNIM-NFFKKD-- 1041

WP_002288990     982 HHAHDAYLNAVIGKALLGVYPQL-EPEFVYGDYPHFH- G---HK---eNK ATAKK--F-FYSNIM-NFFKKD-- 1041

WP_002289641     982 HHAHDAYLNAVIGKALLGVYPQL-EPEFVYGDYPHFH- G---HK---eNK ATAKK--F-FYSNIM-NFFKKD-- 1041

WP_002290427     982 HHAHDAYLNAVIGKALLGVYPQL-EPEFVYGDYPHFH- G---HK---eNK ATAKK--F-FYSNIM-NFFKKD-- 1041

WP_002295753     982 HHAHDAYLNAVIGKALLGVYPQL-EPEFVYGDYPHFH- G---HK---eNK ATAKK--F-FYSNIM-NFFKKD-- 1041

WP_002296423     982 HHAHDAYLNAVIGKALLGVYPQL-EPEFVYGDYPHFH- G---HK---eNK ATAKK--F-FYSNIM-NFFKKD-- 1041

WP_002304487     996 HHAHDAYLNAVIGKALLGVYPQL-EPEFVYGDYPHFH- G---HK---eNK ATAKK--F-FYSNIM-NFFKKG-- 1055

WP_002305844     982 HHAHDAYLNAVIGKALLGVYPQL-EPEFVYGDYPHFH- G---HK---eNK ATAKK--F-FYSNIM-NFFKKD-- 1041

WP_002307203     982 HHAHDAYLNAVIGKALLGVYPQL-EPEFVYGDYPHFH- G---HK---eNK ATAKK--F-FYSNIM-NFFKKD-- 1041

WP_002310390     982 HHAHDAYLNAVIGKALLGVYPQL-EPEFVYGDYPHFH- G---HK---eNK ATAKK--F-FYSNIM-NFFKKD-- 1041

WP_002352408     982 HHAHDAYLNAVIGKALLGVYPQL-EPEFVYGDYPHFH- G---HK---eNK ATAKK--F-FYSNIM-NFFKKD-- 1041

WP_012997688     982 HHAHDAYLNAVIGKALLGVYPQL-EPEFVYGDYPHFH- G---HK---eNK ATAKK--F-FYSNIM-NFFKKD-- 1041

WP_014677909     982 HHAHDAYLNAVIGKALLGVYPQL-EPEFVYGDYPHFH- G---HK---eNK ATAKK--F-FYSNIM-NFFKKD-- 1041

WP_019312892     982 HHAHDAYLNAVIGKALLGVYPQL-EPEFVYGDYPHFH- G---HK---eNK ATAKK--F-FYSNIM-NFFKKD-- 1041

WP_019313659     982 HHAHDAYLNAVIGKALLGVYPQL-EPEFVYGDYPHFH- G---HK---eNK ATAKK--F-FYSNIM-NFFKKD-- 1041
```

-continued

| | | | | |
|---|---|---|---|---|
| WP_019314093 | 982 | HHAHDAYLNAVIGKALLGVYPQL-EPEFVYGDYPHFH- G---HK---eNK ATAKK--F-FYSNIM-NFFKKD-- | 1041 |
| WP_019315370 | 982 | HHAHDAYLNAVIGKALLGVYPQL-EPEFVYGDYPHFH- G---HE---eNK ATAKK--F-FYSNIM-NFFKKD-- | 1041 |
| WP_019803776 | 982 | HHAHDAYLNAVIGKALLGVYPQL-EPEFVYGDYPHFH- G---HK---eNK ATAKK--F-FYSNIM-NFFKKD-- | 1041 |
| WP_019805234 | 982 | HHAHDAYLNAVIGKALLGVYPQL-EPEFVYGDYPHFH- G---HK---eNK ATAKK--F-FYSNIM-NFFKKD-- | 1041 |
| WP_024783594 | 982 | HHAHDAYLNAVIGKALLGVYPQL-EPEFVYGDYPHFH- G---HK---eNK ATAKK--F-FYSNIM-NFFKKD-- | 1041 |
| WP_024784288 | 984 | HHAHDAYLNAVVKALLVKYPKL-EPEFVYGEYLKYN- S---YR---eRK ATQKM--F-FYSNIM-NMFKSKVK | 1046 |
| WP_024784666 | 982 | HHAHDAYLNAVIGKALLGVYPQL-EPEFVYGDYPHFH- G---HK---eNK ATAKK--F-FYSNIM-NFFKKD-- | 1041 |
| WP_024784894 | 982 | HHAHDAYLNAVIGKALLGVYPQL-EPEFVYGDYPHFH- G---HK---eNK ATAKK--F-FYSNIM-NFFKKD-- | 1041 |
| WP_024786433 | 984 | HHAHDAYLNAVVKALLVKYPKL-EPEFVYGEYPKYN- S---YR---eRK ATQKM--F-FYSNIM-NMFKSKVK | 1046 |
| WP_049473442 | 982 | HHAHDAYLNAVIGKALLGVYPQL-EPEFVYGDYPHFH- G---HE---eNK ATAKK--F-FYSNIM-NFFKKD-- | 1041 |
| WP_049474547 | 982 | HHAHDAYLNAVIGKALLGVYPQL-EPEFVYGDYPHFH- G---HK---eNK ATAKK--F-FYSNIM-NFFKKD-- | 1041 |
| EMC03581 | 975 | HHAHDAYLNAVIGKALLGVYPQL-EPEFVYGDYPHFH- G---HK---eNK ATAKK--F-FYSNIM-NFFKKD-- | 1034 |
| WP_000428612 | 987 | HHAHDAYLNAVAKAILKKYPKL-EPEFVYGDYQKYDL SkdpKEI---EK ATEKY--F-FYSNLL-NFFKEEVH | 1058 |
| WP_000428613 | 985 | HHAHDAYLNAVAKAILKKYPKL-EPEFVYGDYQKYDL SrnpKEV---EK ATEKY--F-FYSNLL-NFFKEEVH | 1056 |
| WP_049523028 | 980 | HHAHDAYLNAVAKAILKKYPKL-EPEFVYGDYQKYDL TkdpKEI---EK ATEKY--F-FYSNLL-NFFKDKVY | 1051 |
| WP_003107102 | 951 | HHAHDAYLNAVVGTALLKKYPKL-EAEFVYGDYKHYDL S---DTSl--GK ATAKM--F-FYSNIM-NFFKKEVR | 1020 |
| WP_054279288 | 983 | HHAHDAYLNAVVGTALLKMYPKL-ASEFVYGDYQKYDL S---GKAs--GH ATAKY--F-FYSNLM-NFFKSEVK | 1052 |
| WP_049531101 | 985 | HHAHDAYLNAVAKAILKKYPKL-EPEFVYGDYQKYDL SrdpKEI---EK ATEKY--F-FYSNLL-NFFKEEVH | 1056 |
| WP_049538452 | 985 | HHAHDAYLNAVAKAILKKYPKL-EPEFVYGDYQKYDL SkdpKDI---EK ATEKY--F-FYSNLL-NFFKEEVH | 1056 |
| WP_049549711 | 987 | HHAHDAYLNAVAKAILKKYPKL-EPEFVYGDYQKNDL SkdpKDI---EK ATEKY--F-FYSNLL-NFFKEEVH | 1058 |
| WP_007896501 | 988 | HHAHDAYLNAVVGTALLKKYPKL-EAEFVYGDYKHFDL S---DPSl--GK ATAKV--F-FYSNIM-NFFKEELS | 1057 |
| EFR44625 | 940 | HHAHDAYLNAVVGTALLKKYPKL-EAEFVYGDYKHFDL S---DPSl--GK ATAKV--F-FYSNIM-NFFKEELS | 1009 |
| WP_002897477 | 984 | HHAHDAYLNAVAKAILKKYPKL-EPEFVYGDYQKYDL FkpsKEI---EK ATEKY--F-FYSNLL-NFFKEEVL | 1055 |
| WP_002906454 | 984 | HHAHDAYLNAVAKAILKKYPKL-EPEFVYGDYQKYDL SkasNTI---DK ATEKY--F-FYSNLL-NFFKEKVR | 1055 |
| WP_009729476 | 985 | HHAHDAYLNAVAKAILKKYPKL-EPEFVYGDYQKYDL SkdpKEI---EK ATEKY--F-FYSNLL-NFFKEEVH | 1056 |
| CQR24647 | 984 | HHAHDAYLNAVAKALLIRYPKL-EPEFVYGEYPKYN- S---YRE---RK ATEKM--F-FYSNIM-NMFKTTIK | 1046 |
| WP_000066813 | 989 | HHAHDAYLNAVLAKAILKKYPKL-EPEFVYGDYQKYDL SrepKEV---EK ATQKY--F-FYSNLL-NFFKEEVH | 1060 |
| WP_009754323 | 985 | HHAHDAYLNAVAKAILKKYPKL-EPEFVYGDYQKYDL SkdpKEV---EK ATEKY--F-FYSNLL-NFFKEEVH | 1056 |
| WP_044674937 | 986 | HHAHDAYLNAVATALLKKYPQL-APEFVYGDYPKYN- S---YKS---RK ATEKV--L-FYSNIM-NFFRRVLV | 1048 |
| WP_044676715 | 988 | HHAHDAYLNAVATALLKKYPQL-APEFVYGDYPKYN- S---YKS---RK ATEKV--L-FYSNIM-NFFRRVLV | 1050 |
| WP_044680361 | 988 | HHAHDAYLNAVATALLKKYPQL-APEFVYGDYPKYN- S---YKS---RK ATEKV--L-FYSNIM-NFFRRVLV | 1050 |
| WP_044681799 | 986 | HHAHDAYLNAVATALLKKYPQL-APEFVYGDYPKYN- S---YKS---RK ATEKV--L-FYSNIM-NFFRRVLV | 1048 |
| WP_049533112 | 981 | HHAHDAYLNAVIGTALLKKYPKL-ASEFVYGEFKKYDV S---DK---eIG KATAK--YfFYSNLM-NFFKKEVK | 1050 |
| WP_029090905 | 952 | HHAQDAFLVAFLGTNITSNYPKI-EMEYLFKGYQHYLN ------Ev--GK AAKPKftF-IVENLS--------- | 1007 |
| WP_006506696 | 977 | HHAHDAYIVALIGGFMRDRYPNMhDSKAVYSEYMKMER ----NKNd--QK -----g---FVINSM-NYPY-EV- | 1038 |
| AIT42264 | 982 | HHAHDAYLNAVVGTALIKKYPKL-ESEFVYGDYKVYDV S---EQEi--GK ATAKY--F-FYSNIM-NFFKTEIT | 1051 |
| WP_034440723 | 981 | HHAHDAYLNGVIALKLLELYPYM-AKDLIYGKYSHRK G---------DK ATQAK--Y-KMSNII-ERFSQDL- | 1041 |
| AKQ21048 | 982 | HHAHDAYLNAVVGTALIKKYPKL-ESEFVYGDYKVYDV S---EQEi--GK ATAKY--F-FYSNIM-NFFKTEIT | 1051 |
| WP_004636532 | 981 | HHGHDAYLNAVVATTIMKVYPNL-KPQFVYGQYKKTSM ----FKE---EK ATARK--H-FYSNIT-KFFKKEKV | 1042 |
| WP_002364836 | 988 | HHGQDAYLNCVVATTLLKVYPNL-APEFVYGEYPKFQT ----FKE---NK ATAKA--I-IYTNLL-RFFTED-- | 1047 |

-continued

| | | | |
|---|---|---|---|
| WP_016631044 | 939 | HHGQDAYLNCVVATTLLKVYPNL-APEFVYGEYPKFQT ----FKE---NK ATAKA--I-IYTNLL-RFFTED-- | 998 |
| EMS75795 | 723 | HHAHDAYLNGVVAIALLKKYPKL-EPEFVYGNYTKENL ----AT---eNK ATAKK--E-FYSNIL-RFFEKE-- | 782 |
| WP_002373311 | 988 | HHGQDAYLNCVVATTLLKVYPNL-APEFVYGEYPKFQA ----FKE---NK ATAKT--I-IYTNLM-RFFTED-- | 1047 |
| WP_002378009 | 988 | HHGQDAYLNCVVATTLLKVYPNL-APEFVYGEYPKFQT ----FKE---NK ATAKA--I-IYTNLL-RFFTED-- | 1047 |
| WP_002407324 | 988 | HHGQDAYLNCVVATTLLKVYPNL-APEFVYGEYPKFQT ----FKE---NK ATAKA--I-IYTNLL-RFFTED-- | 1047 |
| WP_002413717 | 988 | HHGQDAYLNCVVATTLLKVYPNL-APEFVYGEYPKFQT ----FKE---NK ATAKA--I-IYTNLL-RFFTED-- | 1047 |
| WP_010775580 | 990 | HHGQDAYLNCVVATTLLKVYPNL-APEFVYGEYPKFQA ----FKE---NK ATAKA--I-IYTNLL-RFFTED-- | 1049 |
| WP_010818269 | 988 | HHGQDAYLNCVVATTLLKVYPNL-APEFVYGEYPKFQT ----FKE---NK ATAKA--I-IYTNLL-RFFTED-- | 1047 |
| WP_010824395 | 988 | HHGQDAYLNCVVATTLLKVYPNL-APEFVYGEYPKFQT ----FKE---NK ATAKT--I-IYTNLM-RFFTED-- | 1047 |
| WP_016622645 | 988 | HHGQDAYLNCVVATTLLKVYPNL-APEFVYGEYPKFQT ----FKE---NK ATAKA--I-IYTNLL-RFFTED-- | 1047 |
| WP_033624816 | 988 | HHGQDAYLNCVVATTLLKVYPNL-APEFVYGEYPKFQA ----FKE---NK AMAKA--I-IYTNLL-RFFTED-- | 1047 |
| WP_033625576 | 988 | HHGQDAYLNCVVATTLLKVYPNL-APEFVYGEYPKFQA ----FKE---NK ATAKA--I-IYTNLM-RFFTEV-- | 1047 |
| WP_033789179 | 988 | HHGQDAYLNCVVATTLLKVYPNL-APEFVYGEYPKFQA ----FKE---NK ATAKA--I-IYTNLL-RFFTED-- | 1047 |
| WP_002310644 | 989 | HHAHDAYLNGVVALALLKKYPQL-APEFVYGEYLKFNA ----HK---aNK ATVKK--E-FYSNIM-KFFESD-- | 1048 |
| WP_002312694 | 990 | HHAHDAYLNGVVALALLKKYPQL-APEFVYGEYLKENA ----HK---aNK ATVKK--E-FYSNIM-KFFESD-- | 1049 |
| WP_002314015 | 990 | HHAHDAYLNGVVALALLKKYPQL-APEFVYGEYLKFNA ----HK---aNK ATVKK--E-FYSNIM-KFFESD-- | 1049 |
| WP_002320716 | 990 | HHAHDAYLNGVVALALLKKYPQL-APEFVYGEYLKFNA ----HK---aNK ATVKK--E-FYSNIM-KFFESD-- | 1049 |
| WP_002330729 | 989 | HHAHDAYLNGVVALALLKKYPQL-APEFVYGEYLKENA ----HK---aNK ATVKK--E-FYSNIM-KFFESD-- | 1048 |
| WP_002335161 | 990 | HHAHDAYLNGVVALALLKKYPQL-APEFVYGEYLKFNA ----HK---aNK ATVKK--E-FYSNIM-KFFESD-- | 1049 |
| WP_002345439 | 990 | HHAHDAYLNGVVALALLKKYPQL-APEFVYGEYLKFNA ----HK---aNK ATVKK--E-FYSNIM-KFFESD-- | 1049 |
| WP_034867970 | 980 | HHAHDAYLNGFIANVLLKRYPKL-APEFVYGKYVKYSL ----AR---eNK ATAKK--E-FYSNIL-KFLESD-- | 1039 |
| WP_047937432 | 990 | HHAHDAYLNGVIALALLKKYPQL-APEFVYGEYLKFNA ----HK---aNK ATVKK--E-FYSNIM-KFFESD-- | 1049 |
| WP_010720994 | 980 | HHAHDAYLNGFIANVLLKRYPKL-APEFVYGKYVKYSL ----AR---eNK ATAKK--E-FYSNIL-KFLESD-- | 1039 |
| WP_010737004 | 980 | HHAHDAYLNGFIANVLLKRYPKL-APEFVYGKYVKYSL ----AR---eNK ATAKK--E-FYSNIL-KFLESD-- | 1039 |
| WP_034700478 | 980 | HHAHDAYLNGFIANVLLKRYPKL-APEFVYGKYVKYSL ----AR---eNK ATAKK--E-FYSNIL-KFLESD-- | 1039 |
| WP_007209003 | 978 | HHAHDAYLNAVVALSLLRVYPQL-KPEFVYGEYGKNS- ----IHDq--NK ATIKK---qFYSNIT-RYFASK-- | 1037 |
| WP_023519017 | 974 | HHAHDAYLNGVVAMTLLKKYPKL-APEFVYGSYIKGDI ----NQ---iNK ATAKK--E-FYSNIM-KFFESE-- | 1033 |
| WP_010770040 | 986 | HHGHDAYLNGVVANSLLRVYPQL-QPEFVYGDYPKFNA ----YKA---NK ATAKK--Q-LYTNIM-KFFAED-- | 1045 |
| WP_048604708 | 983 | HHAHDAYLNGVVATALLKIYPQL-EPEFVYGEFHRFNA ----FKE---NK ATAKK--Q-FYSNLM-EFSKSD-- | 1042 |
| WP_010750235 | 983 | HHAHDAYLNAVVALALLKKYPRL-APEFVYGSFAKFHL ----VK---eNK ATAKK--E-FYSNIL-KFFEKE-- | 1042 |
| AII16583 | 1021 | HHAHDAYLNAVVGTALIKKYPKL-ESEFVYGDYKVYDV S---EQEi--GK ATAKY--F-FYSNIM-NFFKTEIT | 1090 |
| WP_029073316 | 988 | HHAHDAYIATILGTYIGHRFESL-DAKYIYGEYQKIFR ----NKNk--DK ---KDg---FILNSM-RNLYADK- | 1052 |
| WP_031589969 | 988 | HHAHDAYIATILGTYIGHRFESL-DAKYIYGEYKRIFR ----QKNk--GK ---NDg---FILNSM-RNIYADK- | 1052 |
| KDA45870 | 973 | HHAHDAYLNAVVANLIMAKYPEL-EPEFVYGKYRKTK- ----FKGl--GK ATAKN---tLYANVL-YELKENEV | 1034 |
| WP_039099354 | 991 | HHAFDAYLTAFVGLYLLKRYPKL-KPYFVYGEYQKAS- ----QQ----DK ---RN--F----NFL-NGLKKD-- | 1043 |
| AKP02966 | 1000 | HHAQDAYLASFLGTYRLRRFPTD-EMLLMNGEYNKFYG ------KElysKK -SRKN-gF-IISPLV-------- | 1062 |
| WP_010991369 | 985 | HHAHDAYLNGVVANTLLKVYPQL-EPEFVYGDYHQFDW ----FKA---NK ATAKK--Q-FYTNIM-LFFAQK-- | 1044 |
| WP_033838504 | 985 | HHAHDAYLNGVVANTLLKVYPQL-EPEFVYGDYHQFDW ----FKA---NK ATAKK--Q-FYTNIM-LFFAQK-- | 1044 |
| EHN60060 | 988 | HHAHDAYLNGVVANTLLKVYPQL-EPEFVYGDYHQFDW ----FKA---NK ATAKK--Q-FYTNIM-LFFAQK-- | 1047 |
| EFR89594 | 754 | HHAHDAYLNGVVANTLLKVYPQL-EPEFVYGDYHQFDW ----FKA---NK ATAKK--Q-FYTNIM-LFFAQK-- | 813 |
| WP_038409211 | 985 | HHAHDAYLNGVVANTLLKVYPQL-EPEFVYGDYHQFDW ----FKA---NK ATAKK--Q-FYTNIM-RFFAKE-- | 1044 |

-continued

```
EFR95520        604 HHAHDAYLNGVVANTLLKVYPQL-EPEFVYGDYHQFDW ----FKA---NK ATAKK--Q-FYTNIM-RFFAKE--    663
WP_003723650    985 HHAHDAYLNGVVANTLLKVYPQL-EPEFVYGEYHQFDW ----FKA---NK ATAKK--Q-FYTNIM-LFFAQK--   1044
WP_003727705    985 HHAHDAYLNGVVANTLLKVYPQL-EPEFVYGEYHQFDW ----FKA---NK ATAKK--Q-FYTNIM-LFFAQK--   1044
WP_003730785    985 HHAHDAYLNGVVANTLLKVYPQL-EPEFVYGEYHQFDW ----FKA---NK ATAKK--Q-FYTNIM-LFFAQK--   1044
WP_003733029    985 HHAHDAYLNGVVANTLLKVYPQL-EPEFVYGEYHQFGW ----FKA---NK ATAKK--Q-FYTNIM-LFFAQK--   1044
WP_003739838    985 HHAHDAYLNGVVANTLLKVYPQL-EPEFVYGEYHQFDW ----FKA---NK ATAKK--Q-FYTNIM-LFFAQK--   1044
WP_014601172    985 HHAHDAYLNGVVANTLLKVYPQL-EPEFVYGEYHQFDW ----FKA---NK ATAKK--Q-FYTNIM-LFFGQK--   1044
WP_023548323    985 HHAHDAYLNGVVANTLLKVYPQL-EPEFVYGEYHQFDW ----FKA---NK ATAKK--Q-FYTNIM-LFFAQK--   1044
WP_031665337    985 HHAHDAYLNGVVANTLLKVYPQL-EPEFVYGEYHQFDW ----FKA---NK ATAKK--Q-FYTNIM-LFFAQK--   1044
WP_031669209    985 HHAHDAYLNGVVANTLLKVYPQL-EPEFVYGEYHQFDW ----FKA---NK ATAKK--Q-FYTNIM-LFFAQK--   1044
WP_033920898    985 HHAHDAYLNGVVANTLLKVYPQL-EPEFVYGEYHQFDW ----FKA---NK ATAKK--Q-FYTNIM-LFFAQK--   1044
AKI42028        988 HHAHDAYLNGVVANTLLKVYPQL-EPEFVYGEYHQFDW ----FKA---NK ATAKK--Q-FYTNIM-LFFGQK--   1047
AKI50529        988 HHAHDAYLNGVVANTLLKVYPQL-EPEFVYGEYHQFDW ----FKA---NK ATAKK--Q-FYTNIM-LFFAQK--   1047
EFR83390        433 HHAHDAYLNGVVANTLLKVYPQL-EPEFVYGEYHQFDW ----FKA---NK ATAKK--Q-FYTNIM-LFFAQK--    492
WP_046323366    985 HHAHDAYLNCVVANTLLKVYPQL-EPEFVYGDYHQFDW ----FKA---NK ATAKK--Q-FYTNIM-LFFAKK--   1044
AKE81011        998 HHAHDAYLNAVVGTALIKKYPKL-ESEFVYGDYKVYDV S---EQEi--GK ATAKY--F-FYSNIM-NFFKTEIT   1067
CUO82355        981 HHAHDAYIVALIGGFMRDRYPNMhDSKAVYSEYMKMFR ----NKNd--QK -----g---FVINSM-NYPY-EV-   1042
WP_033162887    983 HHAHDAYIACIVGQFMHQNFEHL-DAKIIYGQYK---- ------KNy--KK ---NYg---FILNSM-NHLQSDI-  1042
AGZ01981       1015 HHAHDAYLNAVVGTALIKKYPKL-ESEFVYGDYKVYDV S---EQEi--GK ATAKY--F-FYSNIM-NFFKTEIT   1084
AKA60242        982 HHAHDAYLNAVVGTALIKKYPKL-ESEFVYGDYKVYDV S---EQEi--GK ATAKY--F-FYSNIM-NFFKTEIT   1051
AKS40380        982 HHAHDAYLNAVVGTALIKKYPKL-ESEFVYGDYKVYDV S---EQEi--GK ATAKY--F-FYSNIM-NFFKTEIT   1051
4UN5_B          986 HHAHDAYLNAVVGTALIKKYPKL-ESEFVYGDYKVYDV S---EQEi--GK ATAKY--F-FYSNIM-NFFKTEIT   1055
WP_010922251   1052 LAN-GEIRKRPLIE    TNGET-GE-IVWDKGRDFATVRKVLS-MPQVNIVKKTEVQT  GGFSK ESIL-PKR-   1114
WP_039695303   1059 YAD-GTVFERPIIE T-NAD-GE-IAWNKQIDFEKVRKVLS-YPQVNIVKKVETQT GGFSK ESIL-PKG-       1120
WP_045635197   1056 YAD-GTIVKRENIE Y-SKDtGE-IAWNKEKDFAIIKKVLS-LPQVNIVKKREVQT GGFSK ESIL-PKG-       1118
5AXW_A          772 YKYsHRVDKKPNRE VNNLN-GL---YDKDND--KLKKLINKSPEKLLMYHHDPQT --YQK KLIMeQYGd      852
WP_009880683    736 LAN-GEIRKRPLIE TNGET-GE-IVWDKGRDFATVRKVLS-MPQVNIVKKTEVQT GGFSK ESIL-PKR-        798
WP_010922251   1052 LAN-GEIRKRPLIE TNGET-GE-IVWDKGRDFATVRKVLS-MPQVNIVKKTEVQT GGFSK ESIL-PKR-       1114
WP_011054416   1052 LAN-GEIRKRPLIE TNGET-GE-IVWDKGRDFATVRKVLS-MPQVNIVKKTEVQT GGFSK ESIL-PKR-       1114
WP_011284745   1052 LAN-GEIRKRPLIE TNGET-GE-IVWDKGRDFATVRKVLS-MPQVNIVKKTEVQT GGFSK ESIL-PKR-       1114
WP_011285506   1052 LAN-GEIRKRPLIE TNGET-GE-IVWDKGRDFATVRKVLS-MPQVNIVKKTEVQT GGFSK ESIL-PKR-       1114
WP_011527619   1052 LAN-GEIRKRPLIE TNGET-GE-IVWDKGRDFATVRKVLS-MPQVNIVKKTEVQT GGFSK ESIL-PKR-       1114
WP_012560673   1052 LAN-GEIRKRPLIE TNGET-GE-IVWDKGRDFATVRKVLS-MPQVNIVKKTEVQT GGFSK ESIL-PKR-       1114
WP_014407541   1051 LAN-GEIRKRPLIE TNGET-GE-IVWDKGRDFATVRKVLS-MPQVNIVKKTEVQT GGFSK ESIL-PKR-       1113
WP_020905136   1052 LAN-GEIRKRPLIE TNGET-GE-IVWDKGRDFATVRKVLS-MPQVNIVKKTEVQT GGFSK ESIL-PKR-       1114
WP_023080005   1051 LAN-GEIRKRPLIE TNGET-GE-IVWDKGRDFATVRKVLS-MPQVNIVKKTEVQT GGFSK ESIL-PKR-       1113
WP_023610282   1051 LAN-GEIRKRPLIE TNGET-GE-IVWDKGRDFATVRKVLS-MPQVNIVKKTEVQT GGFSK ESIL-PKR-       1113
WP_030125963   1052 LAN-GEIRKRPLIE TNGET-GE-IVWDKGRDFATVRKVLS-MPQVNIVKKTEVQT GGFSK ESIL-PKR-       1114
WP_030126706   1052 LAN-GEIRKRPLIE TNGET-GE-IVWDKGRDFATVRKVLS-MPQVNIVKKTEVQT GGFSK ESIL-PKR-       1114
WP_031488318   1052 LAN-GEIRKRPLIE TNGET-GE-IVWDKGRDFATVRKVLS-MPQVNIVKKTEVQT GGFSK ESIL-PKR-       1114
```

-continued

| | | | |
|---|---|---|---|
| WP_032460140 | 1052 | LAN-GEIRKRPLIE TNGET-GE-IVWDKGRDFATVRKVLS-MPQVNIVKKTEVQT GGFSK ESIL-PKR- | 1114 |
| WP_032461047 | 1052 | LAN-GEIRKRPLIE TNGET-GE-IVWDKGRDFATVRKVLS-MPQVNIVKKTEVQT GGFSK ESIL-PKR- | 1114 |
| WP_032462016 | 1052 | LAN-GEIRKRPLIE TNGET-GE-IVWDKGRDFATVRKVLS-MPQVNIVKKTEVQT GGFSK ESIL-PKR- | 1114 |
| WP_032462936 | 1052 | LAN-GEIRKRPLIE INGET-GE-IVWDKGRDFATVRKVLS-MPQVNIVKKTEVQT GGFSK ESIL-PKR- | 1114 |
| WP_032464890 | 1052 | LAN-GEIRKRPLIE TNGET-GE-IVWDKGRDFATVRKVLS-MPQVNIVKKTEVQT GGFSK ESIL-PKR- | 1114 |
| WP_033888930 | 877 | LAN-GEIRKRPLIE TNGET-GE-IVWDKGRDFATVRKVLS-MPQVNIVKKTEVQT GGFSK ESIL-PKR- | 939 |
| WP_038431314 | 1052 | LAN-GEIRKRPLIE TNGET-GE-IVWDKGRDFATVRKVLS-MPQVNIVKKTEVQT GGFSK ESIL-PKR- | 1114 |
| WP_038432938 | 1051 | LAN-GEIRKRPLIE TNGET-GE-IVWDKGRDFATVRKVLS-MPQVNIVKKTEVQT GGFSK ESIL-PKR- | 1113 |
| WP_038434062 | 1052 | LAN-GEIRKRPLIE TNGET-GE-IVWDKGRDFATVRKVLS-MPQVNIVKKTEVQT GGFSK ESIL-PKR- | 1114 |
| BAQ51233 | 963 | LAN-GEIRKRPLIE TNGET-GE-IVWDKGRDFATVRKVLS-MPQVNIVKKTEVQT GGFSK ESIL-PKR- | 1025 |
| KGE60162 | 227 | LAN-GEIRKRPLIE TNGET-GE-IVWDKGRDFATVRKVLS-MPQVNIVKKTEVQT GGFSK ESIL-PKR- | 289 |
| KGE60856 | 1 | ------------IE TNGET-GE-IVWDKGRDFATVRKVLS-MPQVNIVKKTEVQT GGFSK ESIL-PKR- | 52 |
| WP_002989955 | 1052 | LAN-GEIRKRPLIE TNGET-GE-IVWDKGRDFATVRKVLS-MPQVNIVKKTEVQT GGFSK ESIL-PKR- | 1114 |
| WP_003030002 | 1042 | -----------DIQ T-NED-GE-IAWNKEKHIKILRKVLS-YPQVNIVKKTEEQT GGFSK ESIL-PKG- | 1093 |
| WP_003065552 | 1059 | YSN-GKVIVRPVVE Y-SKD-TEdIAWDKKSNFRTICKVLS-YPQVNIVKKVETQT GGFSK ESIL-PKG- | 1121 |
| WP_001040076 | 1050 | LAD-GTVVVKDDIE VNNDT-GE-IVWDKKKHFATVRKVLS-YPQVNIVKKTEIQT GGFSK ESIL-AHG- | 1112 |
| WP_001040078 | 1058 | LAD-GSIVVRPVIE TGRYM-GK-TAWDKKKHFATVRKVLS-YPQVNIVKKTEIQT GGFSK ESIL-AHG- | 1120 |
| WP_001040080 | 1050 | LAD-GTVVVKDDIE VNNDT-GE-IVWDKKKHFATVRKVLS-YPQNNIVKKTEIQT GGFSK ESIL-AHG- | 1112 |
| WP_001040081 | 1050 | LAD-GTVVVKDDIE VNNDT-GE-IVWDKKKHFATVRKVLS-YPQNNIVKKTEIQT GGFSK ESIL-AHG- | 1112 |
| WP_001040083 | 1050 | LAD-GTVVVKDDIE VNNDT-GE-IVWDKKKHFATVRKVLS-YPQNNIVKKTEIQT GGFSK ESIL-AHG- | 1112 |
| WP_001040085 | 1050 | LAD-GTVVVKDDIE VNNDT-GE-IVWDKKKHFATVRKVLS-YPQNNIVKKTEIQT GGFSK ESIL-AHG- | 1112 |
| WP_001040087 | 1050 | LAD-GTVVVKDDIE VNNDT-GE-IVWDKKKHFATVRKVLS-YPQNNIVKKTEIQT GGFSK ESIL-AHG- | 1112 |
| WP_001040088 | 1050 | LAD-GTVVVKDDIE VNNDT-GE-IVWDKKKHFATVRKVLS-YPQNNIVKKTEIQT GGFSK ESIL-AHG- | 1112 |
| WP_001040089 | 1050 | LAD-GTVVVKDDIE VNNDT-GE-IVWDKKKHFATVRKVLS-YPQNNIVKKTEIQT GGFSK ESIL-AHG- | 1112 |
| WP_001040090 | 1050 | LAD-GTVVVKDDIE VNNDT-GE-IVWDKKKHFATVRKVLS-YPQNNIVKKTEIQT GGFSK ESIL-AHG- | 1112 |
| WP_001040091 | 1050 | LAD-GTVVVKDDIE VNNDT-GE-IVWDKKKHFATVRKVLS-YPQNNIVKKTEIQT GGFSK ESIL-AHG- | 1112 |
| WP_001040092 | 1050 | LAD-ETVVVKDDIE VNNET-GE-IAWDKKKHFATVRKVLS-YPQVNIVKKTEVQT GGFSK ESIL-AHS- | 1112 |
| WP_001040094 | 1050 | LAD-GTVVVKDDIE VNNDT-GE-IVWDKKKHFATVRKVLS-YPQVNIVKKTEIQT GGFSK ESIL-AHG- | 1112 |
| WP_001040095 | 1050 | LAD-GTVVVKDDIE VNNDT-GE-IVWDKKKHFATVRKVLS-YPQVNIVKKTEVQT GGFSK ESIL-AHG- | 1112 |
| WP_001040096 | 1050 | LAD-GTVVVKDDIE VNNDT-GE-IVWDKKKHFATVRKVLS-YPQVNIVKKTEVQT GGFSK ESIL-AHG- | 1112 |
| WP_001040097 | 1050 | LAD-GTVVVKDDIE VNNDT-GE-IVWDKKKHFATVRKVLS-YPQVNIVKKTEIQT GGFSK ESIL-AHG- | 1112 |
| WP_001040098 | 1050 | LAD-GTVVVKDDIE VNNDT-GE-IVWDKKKHFATVRKVLS-YPQVNIVKKTEIQT GGFSK ESIL-AHG- | 1112 |
| WP_001040099 | 1050 | LAD-GTVVVKDDIE VNNDT-GE-IVWDKKKHFATVRKVLS-YPQVNIVKKTEIQT GGFSK ESIL-AHG- | 1112 |
| WP_001040100 | 1050 | LAD-GTVVVKDDIE VNNDT-GE-IVWDKKKHFATVRKVLS-YPQVNIVKKTEIQT GGFSK ESIL-AHG- | 1112 |
| WP_001040104 | 1050 | LAD-GTVVVKDDIE VNNDT-GE-IVWDKKKHFATVRKVLS-YPQNNIVKKTEIQT GGFSK ESIL-AHG- | 1112 |
| WP_001040105 | 1050 | LAD-GTVVVKDDIE VNNDT-GE-IVWDKKKHFATVRKVLS-YPQNNIVKKTEIQT GGFSK ESIL-AHG- | 1112 |
| WP_001040106 | 1050 | LAD-GTVVVKDDIE VNNDT-GE-IVWDKKKHFATVRKVLS-YPQVNIVKKTEIQT GGFSK ESIL-AHG- | 1112 |
| WP_001040107 | 1050 | LAD-GTVVVKDDIE VNNDT-GE-IVWDKKKHFATVRKVLS-YPQVNIVKKTEIQT GGFSK ESIL-AHG- | 1112 |
| WP_001040108 | 1050 | LAD-GTVVVKDDIE VNNDT-GE-IVWDKKKHFATVRKVLS-YPQVNIVKKTEIQT GGFSK ESIL-AHG- | 1112 |
| WP_001040109 | 1050 | LAD-GTVVVKDDIE VNNDT-GE-IVWDKKKHFATVRKVLS-YPQVNIVKKTEIQT GGFSK ESIL-AHG- | 1112 |

-continued

| | | | |
|---|---|---|---|
| WP_001040110 | 1050 LAD-GTVVVKDDIE VNNDT-GE-IVWDKKKHFATVRKVLS-YPQVNIVKKTEIQT GGFSK ESIL-AHG- | 1112 |
| WP_015058523 | 1050 LAD-ETVVVKDDIE VNNET-GE-IAWDKKKHFATVRKVLS-YPQVNIVKKTEVQT GGFSK ESIL-AHS- | 1112 |
| WP_017643650 | 1050 LAD-GTVVVKDDIE VNNDT-GE-IVWDKKKHFATVRKVLS-YPQVNIVKKTEIQT GGFSK ESIL-AHG- | 1112 |
| WP_017647151 | 1050 LAD-GTVVVKDDIE VNNDT-GE-IVWDKKKHFATVRKVLS-YPQVNIVKKTEIQT GGFSK ESIL-AHG- | 1112 |
| WP_017648376 | 1050 LAD-GTVVVKDDIE VNNDT-GE-IVWDKKKHFATVRKVLS-YPQVNIVKKTEIQT GGFSK ESIL-AHG- | 1112 |
| WP_017649527 | 1050 LAD-GTVVVKDDIE VNNDT-GE-IVWDKKKHFATVRKVLS-YPQNNIVKKTEIQT GGFSK ESIL-AHG- | 1112 |
| WP_017771611 | 1050 LAD-GTVVVKDDIE VNNDT-GE-IVWDKKKHFATVRKVLS-YPQVNIVKKTEIQT GGFSK ESIL-AHG- | 1112 |
| WP_017771984 | 1050 LAD-GTVVVKDDIE VNNDT-GE-IVWDKKKHFATVRKVLS-YPQNNIVKKTEIQT GGFSK ESIL-AHG- | 1112 |
| CFQ25032 | 1050 LAD-GTVVVKDDIE VNNDT-GE-IVWDKKKHFATVRKVLS-YPQNNIVKKTEIQT GGFSK ESIL-AHG- | 1112 |
| CFV16040 | 1050 LAD-GTVVVKDDIE VNNDT-GE-IVWDKKKHFATVRKVLS-YPQNNIVKKTEIQT GGFSK ESIL-AHG- | 1112 |
| KLJ37842 | 1050 LAD-GTVVVKDDIE VNNDT-GE-IVWDKKKHFATVRKVLS-YPQNNIVKKTEIQT GGFSK ESIL-AHG- | 1112 |
| KLJ72361 | 1050 LAD-GTVVVKDDIE VNNDT-GE-IVWDKKKHFATVRKVLS-YPQNNIVKKTEIQT GGFSK ESIL-AHG- | 1112 |
| KLL20707 | 1064 LAD-GTVVVKDDIE VNNDT-GE-IVWDKKKHFATVRKVLS-YPQNNIVKKTEIQT GGFSK ESIL-AHG- | 1126 |
| KLL42645 | 1050 LAD-GTVVVKDDIE VNNDT-GE-IVWDKKKHFATVRKVLS-YPQVNIVKKTEIQT GGFSK ESIL-AHG- | 1112 |
| WP_047207273 | 1050 LAD-GTVVVKDDIE VNNDT-GE-IVWDKKKHFATVRKVLS-YPQNNIVKKTEIQT GGFSK ESIL-AHG- | 1112 |
| WP_047209694 | 1050 LAD-GTVVVKDDIE VNNDT-GE-IVWDKKKHFATVRKVLS-YPQVNIVKKTEIQT GGFSK ESIL-AHG- | 1112 |
| WP_050198062 | 1050 LAD-GTVVIKDDIE VNNDT-GE-IVWDKKKHFATVRKVLS-YPQNNIVKKTEIQT GGFSK ESIL-AHG- | 1112 |
| WP_050201642 | 1050 LAD-GTVVVKDDIE VNNDT-GE-IVWDKKKHFATVRKVLS-YPQNNIVKKTEIQT GGFSK ESIL-AHG- | 1112 |
| WP_050204027 | 1050 LAD-GTVVVKDDIE VNNDT-GE-IVWDKKKHFATVRKVLS-YPQNNIVKKTEIQT GGFSK ESIL-AHG- | 1112 |
| WP_050881965 | 1050 LAD-GTVVVKDDIE VNNDT-GE-IVWDKKKHFATVRKVLS-YPQNNIVKKTEIQT GGFSK ESIL-AHG- | 1112 |
| WP_050886065 | 1050 LAD-GTVVVKDDIE VNNDT-GE-IVWDKKKHFATVRKVLS-YPQNNIVKKTEIQT GGFSK ESIL-AHG- | 1112 |
| AHN30376 | 1050 LAD-ETVVVKDDIE VNNET-GE-IAWDKKKHFATVRKVLS-YPQVNIVKKTEVQT GGFSK ESIL-AHS- | 1112 |
| EAO78426 | 1050 LAD-GTVVVKDDIE VNNDT-GE-IVWDKKKHFATVRKVLS-YPQVNIVKKTEIQT GGFSK ESIL-AHG- | 1112 |
| CCW42055 | 1050 LAD-GTVVVKDDIE VNNDT-GE-IVWDKKKHFATVRKVLS-YPQNNIVKKTEIQT GGFSK ESIL-AHG- | 1112 |
| WP_003041502 | 1051 FAD-GTVVERPDIE T-SED-GE-IAWNKQTDFKIVRKVLS-YPQVNIVKKTEVQT HGLDR PSPK-PKP- | 1122 |
| WP_037593752 | 1043 -----------DIQ T-NED-GE-IAWNKEKHIKILRKVLS-YPQVNIVKKTEEQT GGFSK ESIL-PKG- | 1094 |
| WP_049516684 | 1043 -----------DIQ T-NED-GE-IAWNKEKHIKILRKVLS-YPQVNIVKKTEEQT GGFSK ESIL-PKG- | 1094 |
| GAD46167 | 1042 -----------DIQ T-NED-GE-IAWNKEKHIKILRKVLS-YPQVNIVKKTEEQT GGFSK ESIL-PKG- | 1093 |
| WP_018363470 | 1063 YSN-GKVIVRPVVE Y-SKDtGE-IAWNKRTDFEKVRKVLS-YPQVNIVKKVETQT GGFSK ESIL-PKG- | 1125 |
| WP_003043819 | 1061 LAN-GEIRKRPLIE TNGET-GE-VVWNKEKDFATVRKVLA-MPQVNIVKKTEVQT GGFSK ESIL-SKR- | 1123 |
| WP_006269658 | 1042 -----------DIQ T-NED-GE-IAWNKEKHIKILRKVLS-YPQVNIVKKTEEQT GGFSK ESIL-PKG- | 1093 |
| WP_048800889 | 1052 FAD-GTVVERPDIE T-SED-GE-IAWNKQTDFKIVRKVLS-YPQVNIVKKVEKQT GRFSK ESIL-PKG- | 1113 |
| WP_012767106 | 1051 LAN-GEIRKRPLIE TNEET-GE-IVWDKGRDFATVRKVLS-MPQVNIVKKTEVQT GALTN ESIY-ARG- | 1113 |
| WP_014612333 | 1051 LAN-GEIRKRPLIE TNEET-GE-IVWDKGRDFATVRKVLS-MPQVNIVKKTEVQT GALTN ESIY-ARG- | 1113 |
| WP_015017095 | 1051 LAN-GEIRKRPLIE TNEET-GE-IVWNKGRDFATVRKVLS-MPQVNIVKKTEVQT GALTN ESIY-ARG- | 1113 |
| WP_015057649 | 1051 LAN-GEIRKRPLIE TNEET-GE-IVWDKGRDFATVRKVLS-MPQVNIVKKTEVQT GALTN ESIY-ARG- | 1113 |
| WP_048327215 | 1051 LAN-GEIRKRPLIE TNEET-GE-IVWDKGRDFATVRKVLS-MPQVNIVKKTEVQT GALTN ESIY-ARG- | 1113 |
| WP_049519324 | 1051 LAN-GEIRKRPLIE TNEET-GE-IVWDKGRDFATVRKVLS-MPQVNIVKKTEVQT GALTN ESIY-ARG- | 1113 |
| WP_012515931 | 1044 L-----------H VNSD--GE-EIWNANKHLPIIKNVLS-IPQVNIVKKTEVQT GGFYK ESIL-SKG- | 1094 |
| WP_021320964 | 1044 L-----------H VNSD--GE-EIWNANKHLPIIKNVLS-IPQVNIVKKTEVQT GGFYK ESIL-SKG- | 1094 |
| WP_037581760 | 1044 L-----------H VNSD--GE-EIWNANKHLPIIKNVLS-IPQVNIVKKTEVQT GGFYK ESIL-SKG- | 1094 |

-continued

| | | | |
|---|---|---|---|
| WP_004232481 | 1062 | YAD-GRVFERPDIE T-NAD-GE-VVWNKQRDFNIVRKVLS-YPQVNIVKKVEVQT GGFSK ESIL-PKG- | 1123 |
| WP_009854540 | 1057 | YAD-GTVFERPIIE T-NAD-GE-IAWNKQIDFEKVRKVLS-YPQVNIVKKVETQT GGFSK ESIL-PKG- | 1118 |
| WP_012962174 | 1057 | YSN-GKVVVRPVIE C-SKDtGE-IAWNKQTDFEKVRRVLS-YPQVNIVKKVETQT GGFSK ESIL-PKG- | 1119 |
| WP_039695303 | 1059 | YAD-GTVFERPIIE T-NAD-GE-IAWNKQIDFEKVRKVLS-YPQVNIVKKVETQT GGFSK ESIL-PKG- | 1120 |
| WP_014334983 | 1062 | YAD-GRVFERPDIE T-NAD-GE-VVWNKQKDFDIVRKVLS-YPQVNIVKKVEAQT GGFSK ESIL-SKG- | 1123 |
| WP_003099269 | 1052 | LAD-DTIFTRPQIE VNTET-GE-IVWDKVKDMQTIRKVMS-YPQVNIVMKTEVQT GGFSK ESIW-PKG- | 1114 |
| AHY15608 | 1052 | LAD-DTIFTRPQIE VNTET-GE-IVWDKVKDMQTIRKVMS-YPQVNIVMKTEVQT GGFSK ESIW-PKG- | 1114 |
| AHY17476 | 1052 | LAD-DTIFTRPQIE VNTET-GE-IVWDKVKDMQTIRKVMS-YPQVNIVMKTEVQT GGFSK ESIW-PKG- | 1114 |
| ESR09100 | | -------------- ---------------------------------- ----- --------- | |
| AGM98575 | 1052 | LAD-DTIFTRPQIE VNTET-GE-IVWDKVKDMQTIRKVMS-YPQVNIVMKTEVQT GGFSK ESIW-PKG- | 1114 |
| ALF27331 | 1042 | -----------DVR T-DKN-GE-IIWKKDEHISNIKKVLS-YPQVNIVKKVEEQT GGFSK ESIL-PKG- | 1093 |
| WP_018372492 | 1056 | --K----------K --DQEtGE-IVWDKKEIENIVKKVIY-SSPVNIVKKREEQS GALFK QSNM-AVGy | 1108 |
| WP_045618028 | 1057 | YAD-GTIVKRENIE Y-SKDtGE-IAWNKEKDFATIKKVLS-LPQVNIVKKTEEQT GGLED NNIV-SKKk | 1124 |
| WP_045635197 | 1056 | YAD-GTIVKRENIE Y-SKDtGE-IAWNKEKDFAIIKKVLS-LPQVNIVKKREVQT GGFSK ESIL-PKG- | 1118 |
| WP_002263549 | 1042 | -----------DVR T-DKN-GE-IIWKKDEHISNIKKVLS-YPQVNIVKKVEEQT GGFSK ESIL-PKG- | 1093 |
| WP_002263887 | 1042 | -----------DVR T-DKN-GE-IIWKKDEHISNIKKVLS-YPQVNIVKKVEEQT GGFSK ESIL-PKG- | 1093 |
| WP_002264920 | 1042 | -----------DVR T-DKN-GE-IIWKKDEYISNIKKVLS-YPQVNIVKKVEEQT GGFSK ESIL-PKG- | 1093 |
| WP_002269043 | 1042 | -----------DVR T-DKN-GE-IIWKKDEHISNIKKVLS-YPQVNIVKKVEEQT GGFSK ESIL-PKG- | 1093 |
| WP_002269448 | 1042 | -----------DVR T-DKN-GE-IIWKKDEHISNIKKVLS-YPQVNIVKKVEEQT GGFSK ESIL-PKG- | 1093 |
| WP_002271977 | 1042 | -----------DVR T-DKN-GE-IIWKKDEHISNIKKVLS-YPQVNIVKKVEEQT GGFSK ESIL-PKG- | 1093 |
| WP_002272766 | 1042 | -----------DVR T-DKN-GE-IIWKKDEHISNIKKVLS-YPQVNIVKKVEEQT GGFSK ESIL-PKG- | 1093 |
| WP_002273241 | 1042 | -----------DVR T-DKN-GE-IIWKKDEHISNIKKVLS-YPQVNIVKKVEEQT GGFSK ESIL-PKG- | 1093 |
| WP_002275430 | 1042 | -----------DVR T-DKN-GE-IIWKKDEHISNIKKVLS-YPQVNIVKKVEEQT GGFSK ESIL-PKG- | 1093 |
| WP_002276448 | 1042 | -----------DVR T-DRN-GE-IIWKKDEHISNIKKVLS-YPQVNIVKKVEEQT GGFSK ESIL-PKG- | 1093 |
| WP_002277050 | 1047 | LAD-DQIVERPMIE VNDET-GE-IAWDKTKHITTVKKVLS-YPQVNIVKKVEEQT GGLED -----PKS- | 1111 |
| WP_002277364 | 1042 | -----------DVR T-DKN-GE-IIWKKDEHISNIKKVLS-YPQVNIVKKVEEQT GGFSK ESIL-PKG- | 1093 |
| WP_002279025 | 1042 | -----------DVR T-DKN-GE-IIWKKDEHISNIKKVLS-YPQVNIVKKVEEQT GGFSK ESIL-PKG- | 1093 |
| WP_002279859 | 1042 | -----------DVR T-DKN-GE-IIWKKDEYISNIKKVLS-YPQVNIVKKVEEQT GGFSK ESIL-PKG- | 1093 |
| WP_002280230 | 1042 | -----------DVR T-DKN-GE-IIWKKDEHISNIKKVLS-YPQVNIVKKVEEQT GGFSK ESIL-PKG- | 1093 |
| WP_002281696 | 1042 | -----------DVR T-DKN-GE-IIWKKDEHISNIKKVLS-YPQVNIVKKVEEQT GGFSK ESIL-PKG- | 1093 |
| WP_002282247 | 1047 | LAD-DQIVERPMIE VNDET-GE-IAWDKTKHITTVKKVLS-YPQVNIVKKVEEQT GGLFD -----PKS- | 1111 |
| WP_002282906 | 1042 | -----------DVR T-DKN-GE-IIWKKDEHISNIKKVLS-YPQVNIVKKVEEQT GGFSK ESIL-PKG- | 1093 |
| WP_002283846 | 1042 | -----------DVR T-DKN-GE-IIWKKDEHISNIKKVLS-YPQVNIVKKVEEQT GGFSK ESIL-PKG- | 1093 |
| WP_002287255 | 1042 | -----------DVR T-DKN-GE-IIWKKDEHISNIKKVLS-YPQVNIVKKVEEQT GGFSK ESIL-PKG- | 1093 |
| WP_002288990 | 1042 | -----------DVR T-DKN-GE-IIWKKDEHISNIKKVLS-YPQVNIVKKVEEQT GGFSK ESIL-PKG- | 1093 |
| WP_002289641 | 1042 | -----------DVR T-DKN-GE-IIWKKDEHISNIKKVLS-YPQVNIVKKVEEQT GGFSK ESIL-PKG- | 1093 |
| WP_002290427 | 1042 | -----------DVR T-DKN-GE-IIWKKDEYISNIKKVLS-YPQVNIVKKVEEQT GGFFK ESIL-PKG- | 1093 |
| WP_002295753 | 1042 | -----------DVR T-DKN-GE-IIWKKDEYISNIKKVLS-YPQVNIVKKVEEQT GGFSK ESIL-PKG- | 1093 |
| WP_002296423 | 1042 | -----------DVR T-DKN-GE-IIWKKDEYISNIKKVLS-YPQVNIVKKVEEQT GGFSK ESIL-PKG- | 1093 |
| WP_002304487 | 1056 | -----------DVR T-DKN-GE-IIWKKDEHISNIKKVLS-YPQVNIVKKVEEQT GGFSK ESIL-PKG- | 1107 |

-continued

```
WP_002305844    1042 -----------DVR T-DKN-GE-IIWKKDEHISNIKKVLS-YPQVNIVKKVEEQT GGFSK ESIL-PKG-    1093

WP_002307203    1042 -----------DVR T-DKN-GE-IIWKKDEYISNIKKVLS-YPQVNIVKKVEEQT GGFSK ESIL-PKG-    1093

WP_002310390    1042 -----------DVR T-DKN-GE-IIWKKDEYISNIKKVLS-YPQVNIVKKVEEQT GGFFK ESIL-PKG-    1093

WP_002352408    1042 -----------DVR T-DKN-GE-IIWKKDEYISNIKKVLS-YPQVNIVKKVEEQT GGFSK ESIL-PKG-    1093

WP_012997688    1042 -----------DVR T-DKN-GE-IIWKKDEHISNIKKVLS-YPQVNIVKKVEEQT GGFSK ESIL-PKG-    1093

WP_014677909    1042 -----------DVR T-DKN-GE-IIWKKDEHISNIKKVLS-YPQVNIVKKVEEQT GGFSK ESIL-PKG-    1093

WP_019312892    1042 -----------DVR T-DKN-GE-IIWKKDEHISNIKKVLS-YPQVNIVKKVEEQT GGFSK ESIL-PKG-    1093

WP_019313659    1042 -----------DVR T-DKN-GE-IIWKKDEHISNIKKVLS-YPQVNIVKKVEEQT GGFSK ESIL-PKG-    1093

WP_019314093    1042 -----------DVR T-DKN-GE-IIWKKDEYISNIKKVLS-YPQVNIVKKVEEQT GGFSK ESIL-PKG-    1093

WP_019315370    1042 -----------DVR T-DKN-GE-IIWKKDEHISNIKKVLS-YPQVNIVKKVEEQT GGFSK ESIL-PKG-    1093

WP_019803776    1042 -----------DVR T-DKN-GE-IIWKKDEHISNIKKVLS-YPQVNIVKKVEEQT GGFSK ESIL-PKG-    1093

WP_019805234    1042 -----------DVR T-DKN-GE-IIWKKDEYISNIKKVLS-YPQVNIVKKVEEQT GGFFK ESIL-PKG-    1093

WP_024783594    1042 -----------DVR T-DKN-GE-IIWKKDEHISNIKKVLS-YPQVNIVKKVEEQT GGFSK ESIL-PKG-    1093

WP_024784288    1047 LAD-DQIVERPMIE VNDET-GE-IAWDKTKHITTVKKVLS-YPQVNIVKKVEEQT GGLFD -----PKS-    1111

WP_024784666    1042 -----------DVR T-DKN-GE-IIWKKDEHISNIKKVLS-YPQVNIVKKVEEQT GGFSK ESIL-PKG-    1093

WP_024784894    1042 -----------DVR T-DKN-GE-IIWKKDEHISNIKKVLS-YPQVNIVKKVEEQT GGFSK ESIL-PKG-    1093

WP_024786433    1047 LAD-DQIVERPMIE VNDET-GE-IAWDKTKHITTVKKVLS-YPQVNIVKKVEEQT GGLFD -----PKS-    1111

WP_049473442    1042 -----------DVR T-DKN-GE-IIWKKDEHISNIKKVLS-YPQVNIVKKVEEQT GGFSK ESIL-PKG-    1093

WP_049474547    1042 -----------DVR T-DKN-GE-IIWKKDEHISNIKKVLS-YPQVNIVKKVEEQT GGFSK ESIL-PKG-    1093

EMC03581        1035 -----------DVR T-DKN-GE-IIWKKDEHISNIKKVLS-YPQVNIVKKVEEQT GGFSK ESIL-PKG-    1086

WP_000428612    1059 YAD-GTIVKRENIE Y-SKDtGE-IAWNKEKDFATIKKVLS-LPQVNIVKKREVQT GGFSK ESIL-PKG-    1121

WP_000428613    1057 YAD-GTIVKRENIE Y-SKDtGE-IAWNKEKDFATIKKVLS-YPQVNIVKKREVQT GGFSK ESIL-PKG-    1119

WP_049523028    1052 YAD-GTIIQRGNVE Y-SKDtGE-IAWNKKRDFAIVRKVLS-YPQVNIVKKTEEQT GGFSK ESIL-PKG-    1114

WP_003107102    1021 LAD-GTVITRPQIE TNTET-GE-IVWDKVKDIKTIRKVLS-IPQINVVKKTEVQT GGFSK ESIL-SKR-    1083

WP_054279288    1053 LAN-GNIIKRSPIE VNEET-GE-IVWDKTKDFGTVRKVLS-APQVNIVKKTEIQT GGFSN ETIL-SKG-    1115

WP_049531101    1057 YAD-GTIVKRENIE Y-SKDtGE-IAWNKEIDFATIRKILS-LSQVNIVKKTEEQT GGLED NNIV-SKKk    1124

WP_049538452    1057 YAD-GTIVKRENIE Y-SKDtGE-IAWNKEKDFATIKKILS-LPQVNIVKKTEEQT GGLED NNIV-SKKk    1124

WP_049549711    1059 YAD-GTIVKRENIE Y-SKDtGE-IAWNKEKDFATIKKVLS-YPQVNIVKKTEEQT GGLED NNIV-SKEk    1126

WP_007896501    1058 LAD-GTLMKRPVIE TNTET-GE-VVWDKVKDFKTIRKVLS-YPQVNIVKKTEIQS GAFSK ESVL-SKG-    1120

EFR44625        1010 LAD-GTLMKRPVIE TNTET-GE-VVWDKVKDFKTIRKVLS-YPQVNIVKKTEIQS GAFSK ESVL-SKG-    1072

WP_002897477    1056 YAD-GTIRKRENIE Y-SKDtGE-IAWDKEKDFATIKKVLS-YPQVNIVKKREVQT GGFSK ESIL-PKG-    1118

WP_002906454    1056 YAD-GTIKKRENIE Y-SNDtGE-IAWNKEKDFATIKKVLS-LPQVNIVKKTEEQT GGLED NNIV-SKKk    1123

WP_009729476    1057 YAD-GTIVKRENIE Y-SKDtGE-IAWNKEKDFATIKKVLS-LPQVNIVKKREVQT GGFSK ESIL-PKG-    1119

CQR24647        1047 LAD-GRVVEKPVIE ANEET-GE-IAWDKTKHFANVKKVLS-YPQVSIVKKVEEQT GGFSK ESIL-PKG-    1109

WP_000066813    1061 YAD-GTIVKRENIE Y-SKDtGE-IAWNKEKDFATVKKVLS-LPQVNIVKKTEVQT GGFSK ESIL-PKG-    1123

WP_009754323    1057 YAD-GTIVKRENIE Y-SKDtGE-IAWNKEKDFVTIKKVLS-YPQVNIVKKREVQT GGFSK ESIL-PKG-    1119

WP_044674937    1049 YSKtGEVRIRPVIE VNKET-GE-IVWDKKSDFRTVRKVLS-YPQVNVVKKVEMQT GGFSK ESIL-QHG-    1112

WP_044676715    1051 YSKtGEVRIRPVIE VNKET-GE-IVWDKKSDFRTVRKVLS-YPQVNVVKKVEMQT GGFSK ESIL-QHG-    1114

WP_044680361    1051 YSKtGEVRIRPVIE VNKET-GE-IVWDKKSDFRTVRKVLS-YPQVNVVKKVEMQT GGFSK ESIL-QHG-    1114

WP_044681799    1049 YSKtGEVRIRPVIE VNKET-GE-IVWDKKSDFKTVRKVLS-YPQVNVVKKVEMQT GGFSK ESIL-QHG-    1112

WP_049533112    1051 FAD-GTVVERPDIE T-SED-GE-IAWNKQTDFKIVRKVLS-YPQVNIVKKTEVQT HGLDR PSPK-PKP-    1122
```

-continued

```
WP_029090905   1008 -KQ---------Q --NSttGE-VKWNPEVDIAKLKRILN-FKQCNIVRKVEEQS GALFK ETIY-PVEe   1061
WP_006506696   1039 --D---------- ------GK-LIWNP-DLINEIKKCFY-YKDCYCTTKLDQKS GQLEN -TVL-SNDa   1084
AIT42264       1052 LAN-GEIRKRPLIE TNGET-GE-IVWDKGRDFATVRKVLS-MPQVNIVKKTEVQT GGFSK ESIL-PKR-   1114
WP_034440723   1042 -----------LA --NPD-GE-IAWEKDKDLNTIRKVLS-SKQINIIKKAEEGK GRLFK ETIN-SRPs   1092
AKQ21048       1052 LAN-GEIRKRPLIE TNGET-GE-IVWDKGRDFATVRKVLS-MPQVNIVKKTEVQT GGFSK ESIL-PKR-   1114
WP_004636532   1043 -------------- VNEET-GE-ILWDTERHLSTIKRVLS-WKQMNIVKKVEKQK GQLWK ETIY-PKG-   1092
WP_002364836   1048 --E---------P RFTKD-GE-ILWSN-SYLKTIKKELN-YHQMNIVKKVEVQK GGFSK ESIK-PKG-   1098
WP_016631044    999 --E---------P RFTKD-GE-ILWSN-SYLKTIKKELN-YHQMNIVKKVEVQK GGFSK ESIK-PKG-   1049
EMS75795        783 --E---------Y SYDEN-GE-IFWDKARHIPQIKKVIS-SHQVNIVKKVEVQT GGFYK ETVN-PKG-    834
WP_002373311   1048 --E---------P RFTKD-SE-ILWSN-SYLKTIKKELN-YHQMNIVKKVEVQK GGFSK ESIK-PKG-   1098
WP_002378009   1048 --E---------P RFTKD-GE-ILWSN-SYLKTIKKELN-YHQMNIVKKVEVQK GGFSK ESIK-PKG-   1098
WP_002407324   1048 --E---------P RFTKD-GE-ILWSN-SYLKTIKKELN-YHQMNIVKKVEVQK GGFSK ESIK-PKG-   1098
WP_002413717   1048 --E---------P RFTKD-GE-ILWSN-SYLKTIKKELN-YHQMNIVKKVEVQK GGFSK ESIK-PKG-   1098
WP_010775580   1050 --E---------P RFTKD-GE-ILWSN-SYLKTIKKELN-YHQMNIVKKVEVQK GGFSK ESIK-PKG-   1100
WP_010818269   1048 --E---------P RFTKD-GE-ILWSN-SYLKTIKKELN-YHQMNIVKKVEVQK GGFSK ESIK-PKG-   1098
WP_010824395   1048 --E---------P RFTKD-GE-ILWSN-SYLKTIKKELN-YHQMNIVKKVEVQK GGFSK ESIK-PKG-   1098
WP_016622645   1048 --E---------P RFTKD-GE-ILWSN-SYLKTIKKELN-YHQMNIVKKVEVQK GGFSK ESIK-PKG-   1098
WP_033624816   1048 --E---------P RFTKD-GE-ILWSN-SYLKTIKKELN-YHQMNIVKKVEVQK GGFSK ESIK-PKG-   1098
WP_033625576   1048 --E---------P RFTKD-GE-ILWSN-SYLKTIKKELN-YHQMNIVKKVEVQK GGFSK ESIK-PKG-   1098
WP_033789179   1048 --E---------P RFTKD-GE-ILWSN-SYLKTIKKELN-YHQMNIVKKVEVQK GGFSK ESIK-PKG-   1098
WP_002310644   1049 --T---------P VCDEN-GE-IFWDKSKSIAQVKKVIN-HHHMNIVKKTEIQK GGFSK ETVE-PKK-   1100
WP_002312694   1050 --T---------P VCDEN-GE-IFWDKSKSIAQVKKVIN-HHHMNIVKKTEIQK GGFSK ETVE-PKK-   1101
WP_002314015   1050 --T---------P VCDEN-GE-IFWDKSKSIAQVKKVIN-HHHMNIVKKTEIQK GGFSK ETVE-PKK-   1101
WP_002320716   1050 --T---------P VCDEN-GE-IFWDKSKSIAQVKKVIN-HHHMNIVKKTEIQK GGFSK ETVE-PKK-   1101
WP_002330729   1049 --T---------P VCDEN-GE-IFWDKSKSIAQVKKVIN-HHHMNIVKKTEIQK GGFSE ETVE-PKK-   1100
WP_002335161   1050 --T---------P VCDEN-GE-IFWDKSKSIAQVKKVIN-HHHMNIVKKTEIQK GGFSK ETVE-PKK-   1101
WP_002345439   1050 --T---------P VCDEN-GE-IFWDKSKSIAQVKKVIN-HHHMNIVKKTEIQK GGFSK ETVE-PKK-   1101
WP_034867970   1040 --E---------P FCDEN-GE-IYWEKSHHLPRIKKVLS-SHQVNVVKKVEQQK GGFYK ETVN-SKE-   1091
WP_047937432   1050 --T---------P VCDEN-GE-IFWDKSKSIAQVKKVIN-HHHMNIVKKTEIQK GGFSK ETVE-PKK-   1101
WP_010720994   1040 --E---------P FCDEN-GE-IYWEKSHHLPRIKKVLS-SHQVNVVKKVEQQK GGFYK ETVN-SKE-   1091
WP_010737004   1040 --E---------P FCDEN-GE-IYWEKSHHLPRIKKVLS-SHQVNVVKKVEQQK GGFYK ETVN-SKE-   1091
WP_034700478   1040 --E---------P FCDEN-GE-IYWEKSHHLPRIKKVLS-SHQVNVVKKVEQQK GGFYK ETVN-SKE-   1091
WP_007209003   1038 --D---------- IINDD-GE-ILWNKQETIAQVIKTLG-MHQVNVVKKVEIQK GGFSK ESIQ-PKG-   1089
WP_023519017   1034 --E---------I ICDEQ-GE-VIWNKKRDLSTIKKTIG-AHQVNIVKKVEKQK GGFYK ETIN-SKA-   1085
WP_010770040   1046 --A---------V IIDEN-GE-ILWDK-KNIATVKKVMS-YPQMNIVKKPEIQT GSFSK ETIK-PKG-   1096
WP_048604708   1043 --K---------V IIDEN-GE-ILWNQ-KKIVTVKKVMN-YRQMNIVKKVEIQK GGFSK ESIL-PKG-   1093
WP_010750235   1043 --E---------Q FCDEN-GE-IFWDKRKHIQQIKKVIS-SHQVNIVKKVEVQT GSFYK ETVN-TKE-   1094
AII16583       1091 LAN-GEIRKRPLIE TNGET-GE-IVWDKGRDFATVRKVLS-MPQVNIVKKTEVQT GGFSK ESIL-PKR-   1153
WP_029073316   1053 --D---------- ----T-GE-VVWDP-EWISRIKKCFY-YKDCFVTKKLEENN GSFFN -TVR-PNDe   1099
WP_031589969   1053 --D---------- ----T-GE-IVWDP-NYIDRIKKCFY-YKDCFVTKKLEENN GTFFN -TVL-PNDt   1099
```

-continued

| | | | |
|---|---|---|---|
| KDA45870 | 1035 | YPF---------- -----------WDKARDLPTIKRYLY-RAQVNKVRKAERQT GGFSD EMLV-PKS- | 1078 |
| WP_039099354 | 1044 | -------------E LVDEN-TEaVIWNKESGLAYLNKIYQ-FKKILVTREVHENS GALEN QTLYaAKDd | 1097 |
| AKP02966 | 1063 | --N-------GTTQ --DRNtGE-IIWNVG-FRDKILKIFN-YHQCNVTRKTEIKT GQFYD QTIYSPKNp | 1118 |
| WP_010991369 | 1045 | --D----------R IIDEN-GE-ILWDK-KYLDTVKKVMS-YRQMNIVKKTEIQK GEFSK ATIK-PKG- | 1095 |
| WP_010991369 | 1045 | --D----------R IIDEN-GE-ILWDK-KYLDTVKKVMS-YRQMNIVKKTEIQK GEFSK ATIK-PKG- | 1095 |
| WP_010991369 | 1048 | --D----------R IIDEN-GE-ILWDK-KYLDTVKKVMS-YRQMNIVKKTEIQK GEFSK ATIK-PKG- | 1098 |
| EFR89594 | 814 | --D----------R IIDEN-GE-ILWDK-KYLDTVKKVMS-YRQMNIVKKTEIQK GEFSK ATIK-PKG- | 864 |
| WP_038409211 | 1045 | --N----------Q IIDKN-GE-ILWDN-RYLDTIKKVLS-YRQMNIVKKTEIQK GEFSN ATVN-PKG- | 1095 |
| EFR95520 | 664 | --N----------Q IIDKN-GE-ILWDN-RYLDTIKKVLS-YRQMNIVKKTEIQK GEFSN ATVN-PKG- | 714 |
| WP_003723650 | 1045 | --E----------R IIDEN-GE-ILWDK-KYLETIKKVLD-YRQMNIVKKTEIQK GEFSK ATIK-PKG- | 1095 |
| WP_003727705 | 1045 | --E----------R IIDEN-GE-ILWDK-KYLETIKKVLD-YRQINIVKKTEIQK GEFSK ATIK-PKG- | 1095 |
| WP_003730785 | 1045 | --E----------R IIDEN-GE-ILWDK-KYLETIKKVLD-YRQINIVKKTEIQK GEFSK ATIK-PKG- | 1095 |
| WP_003733029 | 1045 | --D----------R IIDEN-GE-ILWDK-RYLETVKKVLG-YRQMNIVKKTEIQK GEFSN VTPN-PKG- | 1095 |
| WP_003739838 | 1045 | --E----------R IIDEN-GE-ILWDK-KYLETIKKVLD-YRQMNIVKKTEIQK GEFSK ATIK-PKG- | 1095 |
| WP_014601172 | 1045 | --E----------R IIDEN-GE-ILWDK-KYLETIKKVLD-YRQMNIVKKTEIQK GEFSK ATIK-PKG- | 1095 |
| WP_023548323 | 1045 | --E----------R IIDEN-GE-ILWDK-KYLETIKKVLN-YRQMNIVKKTEIQK GEFSN QNPK-PRG- | 1095 |
| WP_031665337 | 1045 | --E----------R IIDEN-GE-ILWDK-KYLETIKKVLD-YRQMNIVKKTEIQK GEFSK ATIK-PKG- | 1095 |
| WP_031669209 | 1045 | --D----------R IIDEN-GE-ILWDK-RYLETVKKVLG-YRQMNIVKKTEIQK GEFSN VTPN-PKG- | 1095 |
| WP_033920898 | 1045 | --E----------R IIDEN-GE-ILWDK-KYLETIKKVLN-YRQMNIVKKTEIQK GEFSN QNPK-PRG- | 1095 |
| AKI42028 | 1048 | --E----------R IIDEN-GE-ILWDK-KYLETIKKVLD-YRQMNIVKKTEIQK GEFSK ATIK-PKG- | 1098 |
| AKI50529 | 1048 | --E----------R IIDEN-GE-ILWDK-KYLETIKKVLN-YRQMNIVKKTEIQK GEFSN QNPK-PRG- | 1098 |
| EFR83390 | 493 | --E----------R IIDEN-GE-ILWDK-KYLETIKKVLD-YRQMNIVKKTEIQK GEFSK ATIK-PKG- | 543 |
| WP_046323366 | 1045 | --D----------R IIDEN-GE-ILWDK-KYLDTIKKVLN-YRQMNIVKKTEIQK GEFSN ATAN-PKG- | 1095 |
| AKE81011 | 1068 | LAN-GEIRKRPLIE TNGET-GE-IVWDKGRDFATVRKVLS-MPQVNIVKKTEVQT GGFSK ESIL-PKR- | 1130 |
| CUO82355 | 1043 | --D----------R ------GK-LIWNP-DLINEIKKCFY-YKDCYCTTKLDQKS GQMFN -TVL-PNDa | 1088 |
| WP_033162887 | 1043 | --D----------R ----T-GE-VMWDP-AKIGKIKSCFY-YKDVYVTKKLEQNS GTLFN -TVL-PNDa | 1089 |
| AGZ01981 | 1085 | LAN-GEIRKRPLIE TNGET-GE-IVWDKGRDFATVRKVLS-MPQVNIVKKTEVQT GGFSK ESIL-PKR- | 1147 |
| AKA60242 | 1052 | LAN-GEIRKRPLIE TNGET-GE-IVWDKGRDFATVRKVLS-MPQVNIVKKTEVQT GGFSK ESIL-PKR- | 1114 |
| AKS40380 | 1052 | LAN-GEIRKRPLIE TNGET-GE-IVWDKGRDFATVRKVLS-MPQVNIVKKTEVQT GGFSK ESIL-PKR- | 1114 |
| 4UN5_B | 1056 | LAN-GEIRKRPLIE TNGET-GE-IVWDKGRDFATVRKVLS-MPQVNIVKKTEVQT GGFSK ESIL-PKR- | 1118 |
| WP_010922251 | 1115 | --NSD KLIA----RKKDW-DPKKYGGFDSPTVAYSV-LVVAK--VE--KGKSKKLKSVKELLGITIME RSSFEK | 1176 |
| WP_039695303 | 1121 | --DSD KLIPRKTKKV-YW-DTKKYGGFDSPTVAYSV-FVVAD--VE--KGKAKKLKTVKELVGISIME RSFFEE | 1185 |
| WP_045635197 | 1119 | --NSD KLIPRKT-KDILL-DTTKYGGFDSPVIAYSI-LLIAD--IE--KGKAKKLKTVKTLVGITIME KAAFEE | 1183 |
| 5AXW_A | 853 | --EKN -LYKYYEeTGNYL---TKYSKKDNGPVIKKI-----------KYYGNKLNAHLDITDDYPNS -VKLSL | 912 |
| WP_009880683 | 799 | --NSD KLIA----RKKDW-DPKKYGGFDSPTVAYSV-LVVAK--VE--KGKSKKLKSVKELVGITIME RSSFEK | 860 |
| WP_010922251 | 1115 | --NSD KLIA----RKKDW-DPKKYGGFDSPTVAYSV-LVVAK--VE--KGKSKKLKSVKELLGITIME RSSFEK | 1176 |
| WP_011054416 | 1115 | --NSD KLIA----RKKDW-DPKKYGGFDSPTVAYSV-LVVAK--VE--KGKSKKLKSVKELLGITIME RSSFEK | 1176 |
| WP_011284745 | 1115 | --NSD KLIA----RKKDW-DPKKYGGFDSPTVAYSV-LVVAK--VE--KGKSKKLKSVKELLGITIME RSSFEK | 1176 |
| WP_011285506 | 1115 | --NSD KLIA----RKKDW-DPKKYGGFDSPTVAYSV-LVVAK--VE--KGKSKKLKSVKELLGITIME RSSFEK | 1176 |
| WP_011527619 | 1115 | --NSD KLIA----RKKDW-DPKKYGGFDSPTVAYSV-LVVAK--VE--KGKSKKLKSVKELLGITIME RSSFEK | 1176 |
| WP_012560673 | 1115 | --NSD KLIA----RKKDW-DPKKYGGFDSPTVAYSV-LVVAK--VE--KGKSKKLKSVKELVGITIME RSSFEK | 1176 |

-continued

```
WP_014407541   1114 --NSD KLIA----RKKDW-DPKKYGGFDSPTVAYSV-LVVAK--VE--KGKSKKLKSVKELLGITIME RSSFEK   1175

WP_020905136   1115 --NSD KLIA----RKKDW-DPKKYGGFDSPTVAYSV-LVVAK--VE--KGKSKKLKSVKELLGLTIME RSSFEK   1176

WP_023080005   1114 --NSD KLIA----RKKDW-DPKKYGGFDSPTVAYSV-LVVAK--VE--KGKSKKLKSVKELLGITIME RSSFEK   1175

WP_023610282   1114 --NSD KLIA----RKKDW-DPKKYGGFDSPTVAYSV-LVVAK--VE--KGKSKKLKSVKELLGITIME RSSFEK   1175

WP_030125963   1115 --NSD KLIA----RKKDW-DPKKYGGFDSPTVAYSV-LVVAK--VE--KGKSKKLKSVKELLGITIME RSSFEK   1176

WP_030126706   1115 --NSD KLIA----RKKDW-DPKKYGGFDSPTVAYSV-LVVAK--VE--KGKSKKLKSVKELLGITIME RSSFEK   1176

WP_031488318   1115 --NSD KLIA----RKKDW-DPKKYGGFDSPTVAYSV-LVVAK--VE--KGKSKKLKSVKELLGITIME RSSFEK   1176

WP_032460140   1115 --NSD KLIA----RKKDW-DPKKYGGFDSPTVAYSV-LVVAK--VE--KGKSKKLKSVKELVGITIME RSSFEK   1176

WP_032461047   1115 --NSD KLIA----RKKDW-DPKKYGGFDSPTVAYSV-LVVAK--VE--KGKSKKLKSVKELVGITIME RSSFEK   1176

WP_032462016   1115 --NSD KLIA----RKKDW-DPKKYGGFDSPTVAYSV-LVVAK--VE--KGKSKKLKSVKELLGITIME RSSFEK   1176

WP_032462936   1115 --NSD KLIA----RKKDW-DPKKYGGFDSPTVAYSV-LVVAK--VE--KGKSKKLKSVKELLGITIME RSSFEK   1176

WP_032464890   1115 --NSD KLIA----RKKDW-DPKKYGGFDSPTVAYSV-LVVAK--VE--KGKSKKLKSVKELLGITIME RSSFEK   1176

WP_033888930    940 --NSD KLIA----RKKDW-DPKKYGGFDSPTVAYSV-LVVAK--VE--KGKSKKLKSVKELLGITIME RSSFEK   1001

WP_038431314   1115 --NSD KLIA----RKKDW-DPKKYGGFDSPTVAYSV-LVVAK--VE--KGKSKKLKSVKELLGITIME RSSFEK   1176

WP_038432938   1114 --NSD KLIA----RKKDW-DPKKYGGFDSPTVAYSV-LVVAK--VE--KGKSKKLKSVKELLGITIME RSSFEK   1175

WP_038434062   1115 --NSD KLIA----RKKDW-DPKKYGGFDSPTVAYSV-LVVAK--VE--KGKSKKLKSVKELLGITIME RSSFEK   1176

BAQ51233       1026 --NSD KLIA----RKKDW-DPKKYGGFDSPTVAYSV-LVVAK--VE--KGKSKKLKSVKELLGITIME RSSFEK   1087

KGE60162        290 --NSD KLIA----RKKDW-DPKKYGGFDSPTVAYSV-LVVAK--VE--KGKSKKLKSVKELLGITIME RSSFEK    351

KGE60856         53 --NSD KLIA----RKKDW-DPKKYGGFDSPTVAYSV-LVVAK--VE--KGKSKKLKSVKELLGITIME RSSFEK    114

WP_002989955   1115 --NSD KLIA----RKKDW-DPKKYGGFDSPTVAYSV-LVVAK--VE--KGKSKKLKSVKELLGITIME RSSFEK   1176

WP_003030002   1094 --ESD KLIPRKT-KNSYW-NPKKYGGFDSPVVAYSI-LVFAD--VE--KGKSKKLRKVQDMVGITIME KKRFEK   1158

WP_003065552   1122 --DSD KLIPRKTkKA-YW-DTKKYGGFDSPTVAYSV-FVVAD--VE--KGKAKKLKTVKELVGISIME RSFFEE   1186

WP_001040076   1113 --NSD KLIPRKT-KDIYL-DPKKYGGFDSPIVAYSV-LVVAD--IK--KGKAQKLKTVTELLGITIME RSRFEK   1177

WP_001040078   1121 --NSD KLIPRKT-KDIYL-DPKKYGGFDSPIVAYSV-LVVAD--IK--KGKAQKLKTVTELLGITIME RSKFEK   1185

WP_001040080   1113 --NSD KLIPRKT-KDIYL-DPKKYGGFDSPIVAYSV-LVVAD--IK--KGKAQKLKTVTELLGITIME RSRFEK   1177

WP_001040081   1113 --NSD KLIPRKT-KDIYL-DPKKYGGFDSPIVAYSV-LVVAD--IK--KGKAQKLKTVTELLGITIME RSRFEK   1177

WP_001040083   1113 --NSD KLIPRKT-KDIYL-DPKKYGGFDSPIVAYSV-LVVAD--IK--KGKAQKLKTVTELLGITIME RSRFEK   1177

WP_001040085   1113 --NSD KLIPRKT-KDIYL-DPKKYGGFDSPIVAYSV-LVVAD--IK--KGKAQKLKTVTELLGITIME RSRFEK   1177

WP_001040087   1113 --NSD KLIPRKT-KDIYL-DPKKYGGFDSPIVAYSV-LVVAD--IK--KGKAQKLKTVTELLGITIME RSRFEK   1177

WP_001040088   1113 --NSD KLIPRKT-KDIYL-DPKKYGGFDSPIVAYSV-LVVAD--IK--KGKAQKLKTVTELLGITIME RSRFEK   1177

WP_001040089   1113 --NSD KLIPRKT-KDIYL-DPKKYGGFDSPIVAYSV-LVVAD--IK--KGKAQKLKTVTELLGITIME RSRFEK   1177

WP_001040090   1113 --NSD KLIPRKT-KDIYL-DPKKYGGFDSPIVAYSV-LVVAD--IK--KGKAQKLKTVTELLGITIME RSRFEK   1177

WP_001040091   1113 --NSD KLIPRKT-KDIYL-DPKKYGGFDSPIVAYSV-LVVAD--IK--KGKAQKLKTVTELLGITIME RSRFEK   1177

WP_001040092   1113 --NSD KLIPRKT-KDIYL-DPKKYGGFDSPIVAYSV-LVLAD--IK--KGKAQKLKTVKELIGITIME RERFEK   1177

WP_001040094   1113 --NSD KLIPRKT-KDIYL-DPKKYGGFDSPIVAYSV-LVVAD--IK--KGKAQKLKTVTELLGITIME RSRFEK   1177

WP_001040095   1113 --NSD KLIPRKT-KDIYL-DPKKYGGFDSPIVAYSV-LVVAD--IK--KGKAQKLKTVTELLGITIME RSRFEK   1177

WP_001040096   1113 --NSD KLIPRKT-KDIYL-DPKKYGGFDSPIVAYSV-LVVAD--IK--KGKAQKLKTVTELLGITIME RSRFEK   1177

WP_001040097   1113 --NSD KLIPRKT-KDIYL-DPKKYGGFDSPIVAYSV-LVVAD--IK--KGKAQKLKTVTELLGITIME RSRFEK   1177

WP_001040098   1113 --NSD KLIPRKT-KDIYL-DPKKYGGFDSPIVAYSV-LVVAD--IK--KGKAQKLKTVTELLGITIME RSRFEK   1177

WP_001040099   1113 --NSD KLIPRKT-KDIYL-DPKKYGGFDSPKVAYSV-LVVAD--IK--KGKAQKLKTVTELLGITIME RSRFEK   1177
```

-continued

| | | | |
|---|---|---|---|
| WP_001040100 | 1113 | --NSD KLIPRKT-KDIYL-DPKKYGGFDSPIVAYSV-LVVAD--IK--KGKAQKLKTVTELLGITIME RSRFEK | 1177 |
| WP_001040104 | 1113 | --NSD KLIPRKT-KDIYL-DPKKYGGFDSPIVAYSV-LVVAD--IK--KGKAQKLKTVTELLGITIME RSRFEK | 1177 |
| WP_001040105 | 1113 | --NSD KLIPRKT-KDIYL-DPKKYGGFDSPIVAYSV-LVVAD--IK--KGKAQKLKTVTELLGITIME RSRFEK | 1177 |
| WP_001040106 | 1113 | --NSD KLIPRKT-KDIYL-DPKKYGGFDSPIVAYSV-LVVAD--IK--KGKAQKLKTVTELLGITIME RFRFEK | 1177 |
| WP_001040107 | 1113 | --NSD KLIPRKT-KDIYL-DPKKYGGFDSPIVAYSV-LVVAD--IK--KGKAQKLKTVTELLGITIME RFRFEK | 1177 |
| WP_001040108 | 1113 | --NSD KLIPRKT-KDIYL-DPKKYGGFDSPIVAYSV-LVVAD--IK--KGKAQKLKTVTELLGITIME RFRFEK | 1177 |
| WP_001040109 | 1113 | --NSD KLIPRKT-KDIYL-DPKKYGGFDSPIVAYSV-LVVAD--IK--KGKAQKLKTVTELLGITIME RFRFEK | 1177 |
| WP_001040110 | 1113 | --NSD KLIPRKT-KDIYL-DPKKYGGFDSPIVAYSV-LVVAD--IK--KGKAQKLKTVTELLGITIME RFRFEK | 1177 |
| WP_015058523 | 1113 | --NSD KLIPRKT-KDIYL-DPKKYGGFDSPIVAYSV-LVLAD--IK--KGKAQKLKTVKELIGITIME RERFEK | 1177 |
| WP_017643650 | 1113 | --NSD KLIPRKT-KDIYL-DPKKYGGFDSPIVAYSV-LVVAD--IK--KGKAQKLKTVTELLGITIME RSRFEK | 1177 |
| WP_017647151 | 1113 | --NSD KLIPRKT-KDIYL-DPKKYGGFDSPIVAYSV-LVVAD--IK--KGKAQKLKTVTELLGITIME RSRFEK | 1177 |
| WP_017648376 | 1113 | --NSD KLIPRKT-KDIYL-DPKKYGGFDSPIVAYSV-LVVAD--IK--KGKAQKLKTVTELLGITIME RSRFEK | 1177 |
| WP_017649527 | 1113 | --NSD KLIPRKT-KDIYL-DPKKYGGFDSPIVAYSV-LVVAD--IK--KGKAQKLKTVTELLGITIME RSRFEK | 1177 |
| WP_017771611 | 1113 | --NSD KLIPRKT-KDIYL-DPKKYGGFDSPIVAYSV-LVVAD--IK--KGKAQKLKTVTELLGITIME RFRFEK | 1177 |
| WP_017771984 | 1113 | --NSD KLIPRKT-KDIYL-DPKKYGGFDSPIVAYSV-LVAAD--IK--KGKAQKLKTVTELLGITIME RSRFEK | 1177 |
| CFQ25032 | 1113 | --NSD KLIPRKT-KDIYL-DPKKYGGFDSPIVAYSV-LVVAD--IK--KGKAQKLKTVTELLGITIME RSRFEK | 1177 |
| CFV16040 | 1113 | --NSD KLIPRKT-KDIYL-DPKKYGGFDSPIVAYSV-LVVAD--IK--KGKAQKLKTVTELLGITIME RSRFEK | 1177 |
| KLJ37842 | 1113 | --NSD KLIPRKT-KDIYL-DPKKYGGFDSPIVAYSV-LVVAD--IK--KGKAQKLKTVTELLGITIME RSRFEK | 1177 |
| KLJ72361 | 1113 | --NSD KLIPRKT-KDIYL-DPKKYGGFDSPIVAYSV-LVVAD--IK--KGKAQKLKTVTELLGITIME RSRFEK | 1177 |
| KLL20707 | 1127 | --NSD KLIPRKT-KDIYL-DPKKYGGFDSPIVAYSV-LVVAD--IK--KGKAQKLKTVTELLGITIME RSRFEK | 1191 |
| KLL42645 | 1113 | --NSD KLIPRKT-KDIYL-DPKKYGGFDSPIVAYSV-LVVAD--IK--KGKAQKLKTVTELLGITIME RFRFEK | 1177 |
| WP_047207273 | 1113 | --NSD KLIPRKT-KDIYL-DPKKYGGFDSPIVAYSV-LVVAD--IK--KGKAQKLKTVTELLGITIME RSRFEK | 1177 |
| WP_047209694 | 1113 | --NSD KLIPRKT-KDIYL-DPKKYGGFDSPIVAYSV-LVVAD--IK--KGKAQKLKTVTELLGITIME RSRFEK | 1177 |
| WP_050198062 | 1113 | --NSD KLIPRKT-KDIYL-DPKKYGGFDSPIVAYSV-LVVAD--IK--KGKAQKLKTVTELLGITIME RSRFEK | 1177 |
| WP_050201642 | 1113 | --NSD KLIPRKT-KDIYL-DPKKYGGFDSPIVAYSV-LVVAD--IK--KGKAQKLKTVTELLGITIME RSRFEK | 1177 |
| WP_050204027 | 1113 | --NSD KLIPRKT-KDIYL-DPKKYGGFDSPIVAYSV-LVVAD--IK--KGKAQKLKTVTELLGITIME RFRFEK | 1177 |
| WP_050881965 | 1113 | --NSD KLIPRKT-KDIYL-DPKKYGGFDSPIVAYSV-LVVAD--IK--KGKAQKLKTVTELLGITIME RSRFEK | 1177 |
| WP_050886065 | 1113 | --NSD KLIPRKT-KDIYL-DPKKYGGFDSPIVAYSV-LVVAD--IK--KGKAQKLKTVTELLGITIME RSRFEK | 1177 |
| AHN30376 | 1113 | --NSD KLIPRKT-KDIYL-DPKKYGGFDSPIVAYSV-LVLAD--IK--KGKAQKLKTVKELIGITIME RERFEK | 1177 |
| EAO78426 | 1113 | --NSD KLIPRKT-KDIYL-DPKKYGGFDSPIVAYSV-LVVAD--IK--KGKAQKLKTVTELLGITIME RSRFEK | 1177 |
| CCW42055 | 1113 | --NSD KLIPRKT-KDIYL-DPKKYGGFDSPIVAYSV-LVVAD--IK--KGKAQKLKTVTELLGITIME RSRFEK | 1177 |
| WP_003041502 | 1123 | --DSS ENLVGVK-RNL---DPKKYGGYAGISNSYAV-LVKAI--IE--KGVKKKETMVLEFQGISILD RITFEK | 1185 |
| WP_037593752 | 1095 | --ESD KLIPRKT-KNSYW-NPKKYGGFDSPVVAYSI-LVFAD--VE--KGKSKKLRKVQDMVGITIME KKRFEK | 1159 |
| WP_049516684 | 1095 | --ESD KLIPRKT-KNSYW-NPKKYGGFDSPVVAYSI-LVFAD--VE--KGKSKKLRKVQDMVGITIME KKRFEK | 1159 |
| GAD46167 | 1094 | --ESD KLIPRKT-KNSYW-NPKKYGGFDSPVVAYSI-LVFAD--VE--KGKSKKLRKVQDMVGITIME KKRFEK | 1158 |
| WP_018363470 | 1126 | --DSD KLIPRKTKKV-LW-EPKKYGGFDSPTVAYSV-LVVAD--VE--KGKTKKLKTVKELVGISIME RSFFEK | 1190 |
| WP_003043819 | 1124 | --ESA KLIP----RKKGW-DTRKYGGFGSPTVAYSI-LVVAK--VE--KGKAKKLKSVKVLVGITIME KGSYEK | 1185 |
| WP_006269658 | 1094 | --ESD KLIPRKT-KNSYW-NPKKYGGFDSPVVAYSI-LVFAD--VE--KGKSKKLRKVQDMVGITIME KKRFEK | 1158 |
| WP_048800889 | 1114 | --DSD KLIARKTkEN-YW-DTKKYGGFDSPTVAYSV-LVVAD--IK--KGKAKKLKTVKELVGISIME RPFFEK | 1178 |
| WP_012767106 | 1114 | --SFD KLIS----RKHRF-ESSKYGGFGSPTVTYSV-LVVAKskVQ--DGKVKKIKTGKELIGMTLLD KLVFEK | 1177 |
| WP_014612333 | 1114 | --SFD KLIS----RKHRF-ESSKYGGFGSPTVTYSV-LVVAKskVQ--DGKVKKIKTGKELIGITLLD KLVFEK | 1177 |

-continued

| | | |
|---|---|---|
| WP_015017095 | 1114 --SFD KLIS----RKHRF-ESSKYGGFGSPTVTYSV-LVVAKSKVQ--DGKVKKIKTGKELIGITLLD KLVFEK | 1177 |
| WP_015057649 | 1114 --SFD KLIS----RKHRF-ESSKYGGFGSPTVTYSV-LVVAKskVQ--DGKVKKIKTGKELIGITLLD KLVFEK | 1177 |
| WP_048327215 | 1114 --SFD KLIS----RKHRF-ESSKYGGFGSPTVTYSV-LVVAKCKVQ--DGKVKKIKTGKELIGITLLD KLVFEK | 1177 |
| WP_049519324 | 1114 --SED KLIS----RKHRF-ESSKYGGFGSPTVTYSV-LVVAKSKVQ--DGKVKKIKTGKELIGITLLD KLVFEK | 1177 |
| WP_012515931 | 1095 --NSD KLIP----RKNNW-DTRKYGGFDSPTVAYSV-LVIAK--ME--KGKAKVLKPVKEMVGITIME RTAFEE | 1156 |
| WP_021320964 | 1095 --NSD KLIP----RKNNW-DTRKYGGFDSPTVAYSV-LVIAK--ME--KGKAKVLKPVKEMVGITIME RIAFEE | 1156 |
| WP_037581760 | 1095 --NSD KLIP----RKNNW-DTRKYGGFDSPTVAYSV-LVIAK--ME--KGKAKVLKPVKEMVGITIME RIAFEE | 1156 |
| WP_004232481 | 1124 --DSD KLIPRKTkKL-QW-ETQKYGGFDSPTVAYSV-LVVAD--VE--KGKTRKLKTVKELVGISIME RSSFEE | 1188 |
| WP_009854540 | 1119 --DSD KLIPRKTkKV-YW-DTKKYGGFDSPTVAYSV-FVVAD--VE--KGKAKKLKTVKELVGISIME RSFFEE | 1183 |
| WP_012962174 | 1120 --NSD KLIPRKTkKF-RW-DTPKYGGFDSPNIAYSV-FVIAD--VE--KGKAKKLKTVKELVGISIME RSSFEE | 1184 |
| WP_039695303 | 1121 --DSD KLIPRKTkKV-YW-DTKKYGGFDSPTVAYSV-FVVAD--VE--KGKAKKLKTVKELVGISIMD RSFFEE | 1185 |
| WP_014334983 | 1124 --DSD KLIPRKTkKV-YW-NTKKYGGFDSPTVAYSV-LVVAD--IE--KGKAKKLKTVKELVGISIME RSFFEE | 1188 |
| WP_003099269 | 1115 --DSD KLIA----RKKSW-DPKKYGGFDSPIIAYSV-LVVAK--IA--KGKTQKLKTIKELVGIKIME QDEFEK | 1176 |
| AHY15608 | 1115 --DSD KLIA----RKKSW-DPKKYGGFDSPIIAYSV-LVVAK--IA--KGKTQKLKTIKELVGIKIME QDEFEK | 1176 |
| AHY17476 | 1115 --DSD KLIA----RKKSW-DPKKYGGFDSPIIAYSV-LVVAK--IA--KGKTQKLKTIKELVGIKIME QDEFEK | 1176 |
| ESR09100 | 1 ----------------------------------------------------------------ME QDEFEK | 8 |
| AGM98575 | 1115 --DSD KLIA----RKKSW-DPKKYGGFDSPIIAYSV-LVVAK--IA--KGKTQKLKTIKELVGIKIME QDEFEK | 1176 |
| ALF27331 | 1094 --NSD KLIPRKT-KKFYW-DTKKYGGFDSPIVAYSI-LVIAN--IE--KGKSKKLKLVKDLVGITIME RTIFEK | 1158 |
| WP_018372492 | 1109 ---NN KLIP----RKKDW-SVDKYGGFIEPAESYSLaIFYTD--IN-----GKKPKKKSTIIAISRME KKDYEK | 1167 |
| WP_045618028 | 1125 vvDAS KLTPIKS-G---L-SPEKYGGYARPTIAYSV-LVIAD--IE--KGKAKKLKRIKEMVGITVQD KKKFEA | 1188 |
| WP_045635197 | 1119 --NSD KLIPRKT-KDILL-DTTKYGGFDSPVIAYSI-LLIAD--IE--KGKAKKLKTVKTLVGITIME KAAFEE | 1183 |
| WP_002263549 | 1094 --NSD KLIPRKT-KKFYW-DTKKYGGFDSPIVAYSI-LVIAD--IE--KGKSKKLKTVKALVGVTIME KMTFER | 1158 |
| WP_002263887 | 1094 --NSD KLIPRKT-KKFYW-DTKKYGGFDSPIVAYSI-LVIAD--IE--KGKSKKLKTVKALVGVTIME KMTFER | 1158 |
| WP_002264920 | 1094 --DSD KLIPRKT-KKFYW-DTKKYGGFDSPIVAYSI-LVIAD--IE--KGKSKKLKTVKALVGVTIME KMTFER | 1158 |
| WP_002269043 | 1094 --NSD KLIPRKT-KKFYW-DTKKYGGFDSPIVAYSI-LVIAD--IE--KGKSKKLKTVKALVGVTIME KMTFER | 1158 |
| WP_002269448 | 1094 --NSD KLIPRKT-KKFYW-DTKKYGGFDSPIVAYSI-LVIAD--IE--KGKSKKLKTVKALVGVTIME KMTFER | 1158 |
| WP_002271977 | 1094 --NSD KLIPRKT-KKFYW-DTKKYGGFDSPIVAYSI-LVIAD--IE--KGKSKKLKTVKALVGVTIME KMTFER | 1158 |
| WP_002272766 | 1094 --NSD KLIPRKT-KKHRW-DTKKYGGFDSPIVAYSI-LVIAD--IE--KGKSKKLKTVKALVGVTIME KMTFER | 1158 |
| WP_002273241 | 1094 --NSD KLIPRKT-KKFYW-DTKKYGGFDSPIVAYSI-LVIAD--IE--KGKSKKLKTVKALVGVTIME KMTFER | 1158 |
| WP_002275430 | 1094 --NSD KLIPRKT-KKFYW-DTKKYGGFDSPIVAYSI-LVIAD--IE--KGKSKKLKTVKALVGVTIME KMTFER | 1158 |
| WP_002276448 | 1094 --NSD KLIPRKT-KKFYW-DTKKYGGEDSPIVAYSI-LVIAD--IE--KGKSKKLKTVKALVGVTIME KMTFER | 1158 |
| WP_002277050 | 1112 --PLE KLVPLKK----AL-NPEKYGGYQKPTTAYPI-LLIVD---------------TKQLIPISVMD KKRFEQ | 1166 |
| WP_002277364 | 1094 --NSD KLIPRKT-KKFYW-DTKKYGGFDSPIVAYSI-LVIAD--IE--KGKSKKLKTVKALVGVTIME KMTFER | 1158 |
| WP_002279025 | 1094 --NSD KLIPRKT-KKFYW-DTKKYGGFDSPIVAYSI-LVIAD--IE--KGKSKKLKTVKALVGVTIME KMTFER | 1158 |
| WP_002279859 | 1094 --DSD KLIPRKT-KKFYW-DTKKYGGFDSPIVAYSI-LVIAD--IE--KGKSKKLKTVKALVGVTIME KMTFER | 1158 |
| WP_002280230 | 1094 --NSD KLIPRKT-KKFYW-DTKKYGGFDSPIVAYSI-LVIAD--IE--KGKSKKLKTVKALVGVTIME KMTFER | 1158 |
| WP_002281696 | 1094 --NSD KLIPRKT-KKFYW-DTKKYGGFDSPIVAYSI-LVIAD--IE--KGKSKKLKTVKALVGVTIME KMTFER | 1158 |
| WP_002282247 | 1112 --PLE KLVPLKK----AL-NPEKYGGYQKPTTAYPI-LLIVD---------------TKQLIPISVMD KKRFEQ | 1166 |
| WP_002282906 | 1094 --NSD KLIPRKT-KKFYW-DTKKYGGFDSPIVAYSI-LVIAD--IE--KGKSKKLKTVKALVGVTIME KMTFER | 1158 |
| WP_002283846 | 1094 --NSD KLIPRKT-KKFYW-DTKKYGGFDSPIVAYSI-LVIAD--IE--KGKSKKLKTVKALVGVTIME KMTFER | 1158 |

-continued

```
WP_002287255   1094 --NSD KLIPRKT-KKFYW-DTKKYGGFDSPIVAYSI-LVIAD--IE--KGKSKKLKTVKALVGVTIME KMTFER   1158
WP_002288990   1094 --NSY KLIPRKT-KKFYW-DTKKYGGFDSPIVAYSI-LVIAD--IE--KGKSKKLKTVKALVGVTIME KMTFER   1158
WP_002289641   1094 --NSD KLIPRKT-KKFYW-DTKKYGGFDSPIVAYSI-LVIAD--IE--KGKSKKLKTVKALVGVTIME KMTFER   1158
WP_002290427   1094 --DSD KLIPRKT-KKFYW-DTKKYGGFDSPIVAYSI-LVIAD--IE--KGKSKKLKTVKALVGVTIME KMTFER   1158
WP_002295753   1094 --NSD KLIPRKT-KKFYW-DTKKYGGFDSPIVAYSI-LVIAD--IE--KGKSKKLKTVKALVGVTIME KMTFER   1158
WP_002296423   1094 --NSD KLIPRKT-KKFYW-DTKKYGGFDSPIVAYSI-LVIAD--IE--KGKSKKLKTVKALVGVTIME KMTFER   1158
WP_002304487   1108 --NSD KLIPRKT-KKFYW-DTKKYGGFDSPIVAYSI-LVIAD--IE--KGKSKKLKTVKALVGVTIME KMTFER   1172
WP_002305844   1094 --NSD KLIPRKT-KKFYW-DTKKYGGFDSPIVAYSI-LVIAD--IE--KGKSKKLKTVKALVGVTIME KMTFER   1158
WP_002307203   1094 --NSD KLIPRKT-KKFYW-DTKKYGGFDSPIVAYSI-LVIAD--IE--KGKSKKLKTVKALVGVTIME KMTFER   1158
WP_002310390   1094 --DSD KLIPRKT-KKFYW-DTKKYGGFDSPIVAYSI-LVIAD--IE--KGKSKKLKTVKALVGVTIME KMTFER   1158
WP_002352408   1094 --DSD KLIPRKT-KKFYW-DTKKYGGFDSPIVAYSI-LVIAD--IE--KGKSKKLKTVKALVGVTIME KMTFER   1158
WP_012997688   1094 --NSD KLIPRKT-KKFYW-DTKKYGGFDSPIVAYSI-LVIAD--IE--KGKSKKLKTVKALVGVTIME KMTFER   1158
WP_014677909   1094 --NSD KLIPRKT-KKFYW-DTKKYGGFDSPIVAYSI-LVIAD--IE--KGKSKKLKTVKALVGVTIME KMTFER   1158
WP_019312892   1094 --NSD KLIPRKT-KKFYW-DTKKYGGFDSPIVAYSI-LVIAD--IE--KGKSKKLKTVKALVGVTIME KMTFER   1158
WP_019313659   1094 --NSD KLIPRKT-KKFYW-DTKKYGGFDSPIVAYSI-LVIAD--IE--KGKSKKLKTVKALVGVTIME KMTFER   1158
WP_019314093   1094 --NSD KLIPRKT-KKFYW-DTKKYGGFDSPIVAYSI-LVIAD--IE--KGKSKKLKTVKALVGVTIME KMTFER   1158
WP_019315370   1094 --NSD KLIPRKT-KKFYW-DTKKYGGFDSPIVAYSI-LVIAD--IE--KGKSKKLKTVKALVGVTIME KMTFER   1158
WP_019803776   1094 --NSD KLIPRKT-KKFYW-DTKKYGGFDSPIVAYSI-LVIAD--IE--KGKSKKLKTVKALVGVTIME KMTFER   1158
WP_019805234   1094 --DSD KLIPRKT-KKFYW-DTKKYGGFDSPIVAYSI-LVIAD--IE--KGKSKKLKTVKALVGVTIME KMTFER   1158
WP_024783594   1094 --NSD KLIPRKT-KKFYW-DTKKYGGFDSPIVAYSI-LVIAD--IE--KSKSKKLKTVKALVGVTIME KMTFER   1158
WP_024784288   1112 --PLE KLVPLKK----AL-NPEKYGGYQKPTTAYPI-LLIVD---------------TKQLIPISVMD KKRFEQ   1166
WP_024784666   1094 --NSD KLIPRKT-KKFYW-DTKKYGGFDSPIVAYSI-LVIAD--IE--KGKSKKLKTVKALVGVTIME KMTFER   1158
WP_024784894   1094 --NSD KLIPRKT-KKFYW-DTKKYGGFDSPIVAYSI-LVIAD--IE--KGKSKKLKTVKALVGVTIME KMTFER   1158
WP_024786433   1112 --PLE KLVPLKK----AL-NPEKYGGYQKPTTAYPI-LLIVD---------------TKQLIPISVMD KKRFEQ   1166
WP_049473442   1094 --NSD KLIPRKT-KKFYW-DTKKYGGFDSPIVAYSI-LVIAD--IE--KGKSKKLKTVKALVGVTIME KMTFER   1158
WP_049474547   1094 --NSD KLIPRKT-KKFYW-DTKKYGGFDSPIVAYSI-LVIAD--IE--KGKSKKLKTVKALVGVTIME KMTFER   1158
EMC03581       1087 --NSD KLIPRKT-KKFYW-DTKKYGGFDSPIVAYSI-LVIAD--IE--KGKSKKLKTVKALVGVTIME KMTFER   1151
WP_000428612   1122 --NSD KLIPRKT-KDILW-DTTKYGGFDSPVIAYSI-LLIAD--IE--KGKAKRLKTVKTLVGITIME KATFEK   1186
WP_000428613   1120 --NSD KLIPRKT-KDILW-ETTKYGGFDSPVIAYSI-LLIAD--IE--KGKAKKLKTVKTLVGITIME KAAFEE   1184
WP_049523028   1115 --NSD KLIPRKT-KNVQL-DTTKYGGFDSPVIAYSI-LLVAD--VE--KGKSKKLKTVKSLIGITIME KVKFEA   1179
WP_003107102   1084 --DSD KLIP----RKNNW-DPKKYGGFGSPIIAYSV-LVVAK--VT--KGKSQKTKSVKELVGITIME QNEFEK   1145
WP_054279288   1116 --KSS KLIP----RKNKWrDTTKYGGFNTPTVAYSV-LVVAK--VE--KGKAKKLKPVKELVGITIME RTKFEA   1178
WP_049531101   1125 vvDAS KLIPIKS-G---L-SPEKYGGYARPTIAYSV-LVIAD--IE--KGKAKKLKRIKEMVGITIQD KKKFEA   1188
WP_049538452   1125 vvDAS KLIPIKS-G---L-SPEKYGGYARPTIAYSV-LVIAD--IE--KGKTKKLKRIKEMIGITVQD KKIFES   1188
WP_049549711   1127 vvDAS KLIPIKS-G---L-SPEKYGGYARPTIAYSV-LVIAD--IE--KGKTKKLKRIKEMVGITIQD KKKFEA   1190
WP_007896501   1121 --NSD KLIE----RKKGW-DPKKYGGFDSPNTAYSI-FVVAK--VA--KRKAQKLKTVKEIVGITIME QAEYEK   1182
EFR44625       1073 --NSD KLIE----RKKGW-DPKKYGGFDSPNTAYSI-FVVAK--VA--KRKAQKLKTVKEIVGITIME QAEYEK   1134
WP_002897477   1119 --NSD KLIPRKT-KDILW-DTTKYGGFDSPVIAYSI-LLIAD--IE--KGKAKKLKTVKTLVGITIME KAAFEE   1183
WP_002906454   1124 vvDAS KLIPIKS-S---L-SPEKYGGYARPTIAYSV-LVIAD--IEkgKGKAKKLKRIKEIVGITIQD KKKFES   1189
WP_009729476   1120 --NSD KLIPRKT-KDILW-DTTKYGGFDSPVIAYSI-LLIAD--IE--KGKAKKLKTVKTLVGITIME KDAFEK   1184
CQR24647       1110 --GSD KLIARKT-KNNYL-STQKYGGFDSPTVAYSI-MFVAD--IE--KGKSKRLKTVKEMIGITIME RSRFES   1174
```

```
WP_000066813  1124 --NSD KLIPRKT-KEILW-DTTKYGGFDSPVIAYSI-LLIAD--IE--KGKAKKLKTVKTLVGITIME KATFEK  1188
WP_009754323  1120 --NSD KLIPRKT-KDILW-DTTKYGGFDSPVIAYSI-LLIAD--IE--KGKAKKLKTVKTLVGITIME KAAFEK  1184
WP_044674937  1113 --DSD KLIPRKT-EKFYL-DTKKYGGFDSPTIAYSV-LLIAD--IE--KGKAKKLKRVKELIGITIME RMAFEK  1177
WP_044676715  1115 --DSD KLIPRKT-EKFYL-DTKKYGGFDSPTIAYSV-LLIAD--IE--KGKAKKLKRVKELIGITIME RMAFEK  1179
WP_044680361  1115 --DSD KLIPRKT-EKFYL-DTKKYGGFDSPTIAYSV-LLIAD--IE--KGKAKKLKRVKELIGITIME RMAFEK  1179
WP_044681799  1113 --DSD KLIPRKT-EKFYL-DTKKYGGFDSPTIAYSV-LLIAD--IE--KGKAKKLKRVKELIGITIME RMAFEK  1177
WP_049533112  1123 --DSS ENLVGVK-RNL---DPKKYGGYAGISNSYAV-LVKAI--IE--KGVKKKETMVLEFQGISILD RITFEK  1185
WP_029090905  1062 --Sss KTIP----LKKHL-DTAIYGGYTAVNYASYA---LIQ--FK----KGRKLK--REIIGIPLAV QTRIDN  1117
WP_006506696  1085 haDKG AVVP---vNKNRS-DVHKYGGFSG--LQYTI----VA--IEgqKKKGKKTELVKKISGVPLHL KAASIN  1149
AIT42264      1115 --NSD KLIA----RKKDW-DPKKYGGFDSPTVAYSV-LVVAK--VE--KGKSKKLKSVKELLGITIME RSSFEK  1176
WP_034440723  1093 k-KTE KRIP----IKNNL-DPNIYGGYIEEKMAYYI----AInyLE--NGKTKK-----AIVGISIKD KKDFEG  1149
AKQ21048      1115 --NSD KLIA----RKKDW-DPKKYGGFDSPTVAYSV-LVVAK--VE--KGKSKKLKSVKELLGITIME RSSFEK  1176
WP_004636532  1093 --DSS KLIP----VKEGM-DPQKYGGLSQVSEAFAV-VIT----HE--KGKKKQLK--SDLISIPIVD QKAYEQ  1150
WP_002364836  1099 --PSN KLIP----VKNGL-DPQKYGGFDSPIVAYTV-LF--T--HE--KGK-KPL-IKQEILGITIME KTRFEQ  1156
WP_016631044  1050 --PSN KLIP----VKNGL-DPQKYGGFDSPVVAYTV-LF--T--HE--KGK-KPL-IKQEILGITIME KTRFEQ  1107
EMS75795       835 --KPD KLIQ----RKAGW-DVSKYGGFGSPVVAYAV-AFI----YE--KGKAR--KKAKAIEGITIMK QSLFEQ   892
WP_002373311  1099 --PSN KLIP----VKNGL-DPQKYGGFDSPVVAYTV-LF--T--HE--KGK-KPL-IKQEILGITIME KTRFEQ  1156
WP_002378009  1099 --PSN KLIP----VKNGL-DPQKYGGFDSPIVAYTV-LF--T--HE--KGK-KPL-IKQEILGITIME KTRFEQ  1156
WP_002407324  1099 --PSN KLIP----VKNGL-DPQKYGGFDSPIVAYTV-LF--T--HE--KGK-KPL-IKQEILGITIME KTRFEQ  1156
WP_002413717  1099 --PSN KLIP----VKNGL-DPQKYGGFDSPVVAYTV-LF--T--HE--KGK-KPL-IKQEILGITIME KTRFEQ  1156
WP_010775580  1101 --PSN KLIP----VKNGL-DPQKYGGFDSPVVAYTV-LF--T--HE--KGK-KPL-IKQEILGITIME KTRFEQ  1158
WP_010818269  1099 --PSN KLIP----VKNGL-DPQKYGGFDSPIVAYTV-LF--T--HE--KGK-KPL-IKQEILGITIME KTRFEQ  1156
WP_010824395  1099 --PSN KLIP----VKNGL-DPQKYGGFDSPVVAYTV-LF--T--HE--KGK-KPL-IKQEILGITIME KTRFEQ  1156
WP_016622645  1099 --PSN KLIP----VKNGL-DPQKYGGFDSPIVAYTV-LF--T--HE--KGK-KPL-IKQEILGITIME KTRFEQ  1156
WP_033624816  1099 --PSN KLIP----VKNGL-DPQKYGGFDSPVVAYTV-LF--T--HE--KGK-KPL-IKQEILGITIME KTRFEQ  1156
WP_033625576  1099 --PSN KLIP----VKNGL-DPQKYGGFDSPVVAYTV-LF--T--HE--KGK-KPL-IKQEILGITIME KTKFEQ  1156
WP_033789179  1099 --PSN KLIP----VKNGL-DPQKYGGFDSPVVAYTV-LF--T--HE--KGK-KPL-IKQEILGITIME KTRFEQ  1156
WP_002310644  1101 --DSS KLLP----RKNNW-DPAKYGGLGSPNVAYTV-AFT----YE--KGKAR--KRTNALEGITIME REAFEQ  1158
WP_002312694  1102 --DSS KLLP----RKNNW-DPAKYGGLGSPNVAYTV-AFT----YE--KGKAR--KRTNALEGITIME REAFEQ  1159
WP_002314015  1102 --DSS KLLP----RKNNW-DPAKYGGLGSPNVAYTV-AFT----YE--KGKAR--KRTNALEGITIME REAFEQ  1159
WP_002320716  1102 --DSS KLLP----RKNNW-DPAKYGGLGSPNVAYTV-AFT----YE--KGKAR--KRTNALEGITIME REAFEQ  1159
WP_002330729  1101 --DSS KLLP----RKNNW-DPAKYGGLGSPNVAYTV-AFT----YE--KGKAR--KRTNALEGITIME REAFEQ  1158
WP_002335161  1102 --DSS KLLP----RKNNW-DPAKYGGLGSPNVAYTV-AFT----YE--KGKAR--KRTNALEGITIME REAFEQ  1159
WP_002345439  1102 --DSS KLLP----RKNNW-DPTKYGGLGSPNVAYTV-AFT----YE--KGKAR--KRTNALEGITIME REAFEQ  1159
WP_034867970  1092 --KPD KLIE----RKNNW-DVTKYGGFGSPVIAYAI-AFV----YA--KGKTQ--KKTRAIEGITIME QAAFEK  1149
WP_047937432  1102 --DSS KLLP----RKNNW-DPAKYGGLGSPNVAYTV-AFT----YE--KGKAR--KRTNALEGITIME REAFEQ  1159
WP_010720994  1092 --KPD KLIE----RKNNW-DVTKYGGFGSPVIAYAI-AFV----YA--KGKTQ--KKTKAIEGITIME QAAFEK  1149
WP_010737004  1092 --KPD KLIE----RKNNW-DVTKYGGFGSPVIAYAI-AFV----YA--KGKTQ--KKTRAIEGITIME QAAFEK  1149
WP_034700478  1092 --KPD KLIE----RKNNW-DVTKYGGFGSPVIAYAI-AFV----YA--KGKTQ--KKTRAIEGITIME QAAFEK  1149
WP_007209003  1090 --ESQ KLIR----RKQQW-NTKKYGGFDSPVVAYAI---LLS--FD--KGK-RKARSFK-IVGITIQD RESFEG  1147
```

-continued
```
WP_023519017   1086 --NPE KLIP----RKASL-DPLKYGGYGSPLVAYTV-IFI----FE--KGKQK--KVTKGIEGITVME QLRFEQ   1143
WP_010770040   1097 --DSD KLIS----RKTNW-SPKLYGGFDSPQVAYSV-II--T--YE--KGK-KKVRA-KAIVGITIME QSLFKK   1154
WP_048604708   1094 --DSD KLIS----RKKEW-DTTKYGGFDSPNVAYSV-VI--R--YE--KGK-TRKLV-KTIVGITIME RAAFEK   1151
WP_010750235   1095 --KPD KLIK----RKNNW-DVTKYGGFGSPVVAYAV-VFT----YE--KGKNH--KKAKAIEGITIME QALFEK   1152
AII16583       1154 --NSD KLIA----RKKDW-DPKKYGGFDSPTVAYSV-LVVAK--VE--KGKSKKLKSVKELLGITIME RSSFEK   1215
WP_029073316   1100 hsEKG AKVP---vNKLRS-NVHKYGGFEG--LKYSI----VA--IKgkKKKGKKIIDVNKLVGIPLMY KNVDDE   1164
WP_031589969   1100 nsDKD ATVP---vNKYRS-NVNKYGGFSG--VNSFI----VA--IKgkKKKGKKVIEVNKLTGIPLMY KNADEE   1164
KDA45870       1079 --DSG KLLP----RKEGL-DPVKYGGYAKAVESYAV-LITAD-eVK--KGKTKKVKT---LVNIPIID SKKYEA   1138
WP_039099354   1098 k-ASG QLIPAKQdRPTAL-----YGGYSGKTVAYMC---IVR--IKnkKGDLYKVCGVETSWLAQLKQ KKAFLK   1170
AKP02966       1119 k---- KLIA----QKKDM-DPNIYGGFSGDNKSSIT---IVK--ID-----NNKIKPVA--IPIRLIN ----DK   1172
WP_010991369   1096 --NSS KLIP----RKTNW-DPMKYGGLDSPNMAYAV-VI--E--YA--KGK-NKLVFEKKIIRVTIME RKAFEK   1154
WP_033838504   1096 --NSS KLIS----RKTNW-DPMKYGGLDSPNMAYAV-VI--E--YA--KGK-NKLVFEKKIIRVTIME RKAFEK   1154
EHN60060       1099 --NSS KLIS----RKTNW-DPMKYGGLDSPNMAYAV-VI--E--YA--KGK-NKLVFEKKIIRVTIME RKAFEK   1157
EFR89594        865 --NSS KLIP----RKTNW-DPMKYGGLDSPNMAYAV-VI--E--YA--KGK-NKLVFEKKIIRVTIME RKAFEK    923
WP_038409211   1096 --NSS KLIS----RKADW-NPIKYGGFDGSNMAYSI-VI--E--YE--KRK-KKTVIKKELIQINIME RVAFEK   1154
EFR95520        715 --NSS KLIS----RKADW-NPIKYGGFDGSNMAYSI-VI--E--YE--KRK-KKTVIKKELIQINIME RVAFEK    773
WP_003723650   1096 --NSS KLIP----RKENW-DPMKYGGLDSPNMAYAV-II--E--HA--KGK-KKIVIEKKLIQINIME RKMFEK   1154
WP_003727705   1096 --NSS KLIP----RKENW-DPMKYGGLDSPNMAYAV-II--E--HA--KGK-KKIVIEKKLIQINIME RKMFEK   1154
WP_003730785   1096 --NSS KLIP----RKENW-DPVKYGGLDSPNMAYAV-II--E--HA--KGK-KKIVIEKKLIQINIME RKMFEK   1154
WP_003733029   1096 --KSN KLIP----RKKDW-DPIKYGGFDGSKMAYAI-II--E--YE--KQK-RKVRIEKKLIQINIME REAFEK   1154
WP_003739838   1096 --NSS KLIP----RKENW-DPMKYGGLDSPNMAYAV-II--E--HA--KGK-KKVVFEKKIIRITIME RKAFEK   1154
WP_014601172   1096 --NSS KLIP----RKENW-DPMKYGGLDSPNMAYAV-II--E--HA--KGK-KKLIFEKKIIRITIME RKMFEK   1154
WP_023548323   1096 --DSS KLIP----KKTNL-NPIKYGGFEGSNMAYAI-II--E--HE--KRK-KKVTIEKKLIQINIME RKAFEK   1154
WP_031665337   1096 --NSS KLIP----RKENW-DPMKYGGLDSPNMAYAV-II--E--HA--KGK-KRIVIEKKLIQINIME RKMFEK   1154
WP_031669209   1096 --KSN KLIP----RKKDW-DPIKYGGFDGSKMAYAI-II--E--YE--KQK-RKVRIEKKLIQINIME REAFEK   1154
WP_033920898   1096 --DSS KLIP----KKTNL-NPIKYGGFEGSNMAYAI-II--E--HE--KRK-KKVTIEKKLIQINIME RKAFEK   1154
AKI42028       1099 --NSS KLIP----RKENW-DPMKYGGLDSPNMAYAV-II--E--HA--KGK-KKLIFEKKIIRITIME RKMFEK   1157
AKI50529       1099 --DSS KLIP----KKTNL-NPIKYGGFEGSNMAYAI-II--E--HE--KRK-KKVTIEKKLIQINIME RKAFEK   1157
EFR83390        544 --NSS KLIP----RKENW-DPMKYGGLDSPNMAYAV-II--E--HA--KGK-KKIVIEKKLIQINIME RKMFEK    602
WP_046323366   1096 --NSS KLIP----RKADW-DPIKYGGFDGSNMAYAI-VI--E--HE--KRK-KKTVIKKELIQINIME RTAFEK   1154
AKE81011       1131 --NSD KLIA----RKKDW-DPKKYGGFDSPTVAYSV-LVVAK--VE--KGKSKKLKSVKELLGITIME RSSFEK   1192
CUO82355       1089 hsAKG AVIP---vNKNRK-DVNKYGGFSG--LQYVI----AA--IEgtKKKGKKLVKVRKLSGIPLYL KQADIK   1153
WP_033162887   1090 hsEKG ATVP---lNKYRA-DVHKYGGFGN--VQSII----VA--IEgkKKKGKKLIDVRKLTSIPLHL KNAPVE   1154
AGZ01981       1148 --NSD KLIA----RKKDW-DPKKYGGFDSPTVAYSV-LVVAK--VE--KGKSKKLKSVKELLGITIME RSSFEK   1209
AKA60242       1115 --NSD KLIA----RKKDW-DPKKYGGFDSPTVAYSV-LVVAK--VE--KGKSKKLKSVKELLGITIME RSSFEK   1176
AKS40380       1115 --NSD KLIA----RKKDW-DPKKYGGFDSPTVAYSV-LVVAK--VE--KGKSKKLKSVKELLGITIME RSSFEK   1176
4UN5_B         1119 --NSD KLIA----RKKDW-DPKKYGGFDSPTVAYSV-LVVAK--VE--KGKSKKLKSVKELLGITIME RSSFEK   1180
WP_010922251   1177 NPI---DFLE----AKGYKE--V-KKDLIIK--LPKYSLFE---LENGRKRMLAS -GELQKGNELALPSKYVNFLYLA  1239
WP_039695303   1186 NPV---EFLE----NKGYHN--I-REDKLIK--LPKYSLFE---FEGGRRRLLAS ASELQKGNEMVLPGYLVELLYHA   1248
WP_045635197   1184 NPI---TFLE----NKGYHN--V-RKENILC--LPKYSLFE---LENGRRRLLAS AKELQKGNEIVLPVYLTTLLYHS   1246
```

-continued

```
5AXW_A          913  KPYrfdVYLD---NGVYKFvtV-KNLDVIK----KENYYE---VNSKAYEEAKK -KKISNQAEFIASFYNNDLIKIN         978
WP_009880683    861  DPV---DFLE----AKGYKE--V-RKDLIIK--LPKYSLFE---LENGRKRMLAS -GELQKGNELALPSKYVNFLYLA         923
WP_010922251   1177  NPI---DFLE----AKGYKE--V-KKDLIIK--LPKYSLFE---LENGRKRMLAS -GELQKGNELALPSKYVNFLYLA        1239
WP_011054416   1177  DPI---DFLE----AKGYKE--V-RKDLIIK--LPKYSLFE---LENGRKRMLAS -GELQKGNELALPSKYVNFLYLA        1239
WP_011284745   1177  NPI---DFLE----AKGYKE--V-RKDLIVK--LPKYSLFE---LENGRKRMLAS -GELQKGNELALPSKYVNFLYLA        1239
WP_011285506   1177  NPI---DFLE----AKGYKE--V-KKDLIIK--LPKYSLFE---LENGRKRMLAS -GELQKGNELALPSKYVNFLYLA        1239
WP_011527619   1177  NPI---DFLE----AKGYKE--V-RKDLIIK--LPKYSLFE---LENGRKRMLAS -GELQKGNELALPSKYVNFLYLA        1239
WP_012560673   1177  DPV---DFLE----AKGYKE--V-RKDLIIK--LPKYSLFE---LENGRKRMLAS -GELQKGNELALPSKYVNFLYLA        1239
WP_014407541   1176  NPI---DFLE----AKGYKE--V-KKDLIIK--LPKYSLFE---LENGRKRMLAS -GELQKGNELALPSKYVNFLYLA        1238
WP_020905136   1177  NPI---DFLE----AKGYKE--V-KKDLIIK--LPKYSLFE---LENGRKRMLAS -GELQKGNELALPSKYVNFLYLA        1239
WP_023080005   1176  NPI---DFLE----AKGYKE--V-RKDLIIK--LPKYSLFE---LENGRKRMLAS -GELQKGNELALPSKYVNFLYLA        1238
WP_023610282   1176  NPI---DFLE----AKGYKE--V-RKDLIIK--LPKYSLFE---LENGRKRMLAS -GELQKGNELALPSKYVNFLYLA        1238
WP_030125963   1177  NPI---DFLE----AKGYKE--V-RKDLIIK--LPKYSLFE---LENGRKRMLAS -GELQKGNELALPSKYVNFLYLA        1239
WP_030126706   1177  NPI---DFLE----AKGYKE--V-RKDLIIK--LPKYSLFE---LENGRKRMLAS -GELQKGNELALPSKYVNFLYLA        1239
WP_031488318   1177  NPI---DFLE----AKGYKE--V-RKDLIIK--LPKYSLFE---LENGRKRMLAS -GELQKGNELALPSKYVNFLYLA        1239
WP_032460140   1177  DPV---DFLE----AKGYKE--V-RKDLIIK--LPKYSLFE---LENGRKRMLAS -GELQKGNELALPSKYVNFLYLA        1239
WP_032461047   1177  DPV---DFLE----AKGYKE--V-RKDLIIK--LPKYSLFE---LENGRKRMLAS -GELQKGNELALPSKYVNFLYLA        1239
WP_032462016   1177  NPI---DFLE----AKGYKE--V-RKDLIIK--LPKYSLFE---LENGRKRMLAS -GELQKGNELALPSKYVNFLYLA        1239
WP_032462936   1177  NPI---DFLE----AKGYKE--V-RKDLIIK--LPKYSLFE---LENGRKRMLAS -GELQKGNELALPSKYVNFLYLA        1239
WP_032464890   1177  NPI---DFLE----AKGYKE--V-RKDLIIK--LPKYSLFE---LENGRKRMLAS -GELQKGNELALPSKYVNFLYLA        1239
WP_033888930   1002  NPI---DFLE----AKGYKE--V-KKDLIIK--LPKYSLFE---LENGRKRMLAS -GELQKGNELALPSKYVNFLYLA        1064
WP_038431314   1177  NPI---DFLE----AKGYKE--V-RKDLIIK--LPKYSLFE---LENGRKRMLAS -GELQKGNELALPSKYVNFLYLA        1239
WP_038432938   1176  NPI---DFLE----AKGYKE--V-RKDLIIK--LPKYSLFE---LENGRKRMLAS -GELQKGNELALPSKYVNFLYLA        1238
WP_038434062   1177  NPI---DFLE----AKGYKE--V-RKDLIIK--LPKYSLFE---LENGRKRMLAS -GELQKGNELALPSKYVNFLYLA        1239
BAQ51233       1088  NPI---DFLE----AKGYKE--V-KKDLIIK--LPKYSLFE---LENGRKRMLAS -GELQKGNELALPSKYVNFLYLA        1150
KGE60162        352  DPI---DFLE----AKGYKE--V-RKDLIIK--LPKYSLFE---LENGRKRMLAS -GELQKGNELALPSKYVNFLYLA         414
KGE60856        115  DPI---DFLE----AKGYKE--V-RKDLIIK--LPKYSLFE---LENGRKRMLAS -GELQKGNELALPSKYVNFLYLA         177
WP_002989955   1177  NPI---DFLE----AKGYKE--V-RKDLIIK--LPKYSLFE---LENGRKRMLAS -GELQKGNELALPSKYVNFLYLA        1239
WP_003030002   1159  HPV---DFLE----QRGYRN--V-RLEKIIK--LPKYSLFE---LENKRRLLAS  ARELQKGNELVIPQRFTTLLYHS        1221
WP_003065552   1187  NPV---EFLE----NKGYHN--I-REDKLIK--LPKYSLFE---FEGGKRRLLAS ASELQKGNEMVIPGHLVKLLYHA        1249
WP_001040076   1178  NPS---AFLE----SKGYLN--I-RTDKLII--LPKYSLFE---LENGRRRLLAS AGELQKGNELALPTQFMKFLYLA        1240
WP_001040078   1186  NPS---AFLE----SKGYLN--I-RDDKLMI--LPKYSLFE---LENGRRRLLAS AGELQKGNELALPTQFMKFLYLA        1248
WP_001040080   1178  NPS---AFLE----SKGYLN--I-RADKLII--LPKYSLFE---LENGRRRLLAS AGELQKGNELALPTQFMKFLYLA        1240
WP_001040081   1178  NPS---AFLE----SKGYLN--I-RADKLII--LPKYSLFE---LENGRRRLLAS AGETIDRLQKGNELALPTQFMKF        1240
                         LYLA
WP_001040083   1178  NPS---AFLE----SKGYLN--I-RADKLII--LPKYSLFE---LENGRRRLLAS AGELQKGNELALPTQFMKFLYLA        1240
WP_001040085   1178  NPS---AFLE----SKGYLN--I-RADKLII--LPKYSLFE---LENGRRRLLAS AGELQKGNELALPTQFMKFLYLA        1240
WP_001040087   1178  NPS---AFLE----SKGYLN--I-RADKLII--LPKYSLFE---LENGRRRLLAS AGELQKGNELALPTQFMKFLYLA        1240
WP_001040088   1178  NPS---AFLE----SKGYLN--I-RADKLII--LPKYSLFE---LENGRRRLLAS AGELQKGNELALPTQFMKFLYLA        1240
WP_001040089   1178  NPS---AFLE----SKGYLN--I-RDDKLMI--LPKYSLFE---LENGRRRLLAS AGELQKGNELALPTQFMKFLYLA        1240
WP_001040090   1178  NPS---AFLE----SKGYLN--I-RADKLII--LPKYSLFE---LENGRRRLLAS AGELQKGNELALPTQFMKFLYLA        1240
```

-continued

```
WP_001040091    1178 NPS---AFLE---SKGYLN--I-RADKLII--LPKYSLFE---LENGRRRLLAS AGELQKGNELALPTQFMKFLYLA 1240

WP_001040092    1178 NPS---AFLE---SKGYLN--I-RTDKLII--LPKYSLFE---LENGRRRLLAS AGELQKGNELALPTQYMKFLYLA 1240

WP_001040094    1178 NPS---AFLE---SKGYLN--I-RDDKLMI--LPKYSLFE---LENGRRRLLAS AGELQKGNELALPTQFMKFLYLA 1240

WP_001040095    1178 NPS---AFLE---SKGYLN--I-RTDKLII--LPKYSLFE---LENGRRRLLAS AGELQKGNELALPTQYMKFLYLA 1240

WP_001040096    1178 NPS---AFLE---SKGYLN--I-RTDKLII--LPKYSLFE---LENGRRRLLAS AGELQKGNELALPTQYMKFLYLA 1240

WP_001040097    1178 NPS---AFLE---SKGYLN--I-RDDKLMI--LPKYSLFE---LENGRRRLLAS ADELQKGNELALPTQFMKFLYLA 1240

WP_001040098    1178 NPS---AFLE---SKGYLN--I-RDDKLMI--LPKYSLFE---LENGRRRLLAS AGELQKGNELALPTQFMKFLYLA 1240

WP_001040099    1178 NPS---AFLE---SKGYLN--I-RDDKLMI--LPKYSLFE---LENGRRRLLAS AGELQKGNELALPTQFMKFLYLA 1240

WP_001040100    1178 NPS---AFLE---SKGYLD--I-RDDKLMI--LPKYSLFE---LENGRRRLLAS AGELQKGNELALPTQFMKFLYLA 1240

WP_001040104    1178 NPS---AFLE---SKGYLN--I-RADKLII--LPKYSLFE---LENGRRRLLAS AGELQKGNELALPTQFMKFLYLA 1240

WP_001040105    1178 NPS---AFLE---SKGYLN--I-RADKLII--LPKYSLFE---LENGRRRLLAS AGELQKGNELALPTQFMKFLYLA 1240

WP_001040106    1178 NPS---AFLE---SKGYLN--I-RDDKLMI--LPKYSLFE---LENGRRRLLAS AGELQKGNELALPTQYMKFLYLA 1240

WP_001040107    1178 NPS---AFLE---SKGYLN--I-RDDKLMI--LPKYSLFE---LENGRRRLLAS AGELQKGNELALPTQYMKFLYLA 1240

WP_001040108    1178 NPS---AFLE---SKGYLN--I-RDDKLMI--LPKYSLFE---LENGRRRLLAS AGELQKGNELALPTQYMKFLYLA 1240

WP_001040109    1178 NPS---AFLE---SKGYLN--I-RDDKLMI--LPKYSLFE---LENGRRRLLAS AGELQKGNELALPTQYMKFLYLA 1240

WP_001040110    1178 NPS---AFLE---SKGYLN--I-RDDKLMI--LPKYSLFE---LENGRRRLLAS AGELQKGNELALPTQYMKFLYLA 1240

WP_015058523    1178 NPS---AFLE---SKGYLN--I-RTDKLII--LPKYSLFE---LENGRRRLLAS AGELQKGNELALPTQYMKFLYLA 1240

WP_017643650    1178 NPS---AFLE---SKGYLN--I-RDDKLMI--LPKYSLFE---LENGRRRLLAS ADELQKGNELALPTQFMKFLYLA 1240

WP_017647151    1178 NPS---AFLE---SKGYLN--I-RDDKLMI--LPKYSLFE---LENGRRRLLAS AGELQKGNELALPTQFMKFLYLA 1240

WP_017648376    1178 NPS---AFLE---SKGYLN--I-RDDKLMI--LPKYSLFE---LENGRRRLLAS AGELQKGNELALPTQFMKFLYLA 1240

WP_017649527    1178 NPS---AFLE---SKGYLN--I-RADKLII--LPKYSLFE---LENGRRRLLAS AGELQKGNELALPTQFMKFLYLA 1240

WP_017771611    1178 NPS---AFLE---SKGYLN--I-RDDKLMI--LPKYSLFE---LENGRRRLLAS AGELQKGNELALPTQFMKFLYLA 1240

WP_017771984    1178 NPS---AFLE---SKGYLN--I-RADKLII--LPKYSLFE---LENGRRRLLAS AGELQKGNELALPTQFMKFLYLA 1240

CFQ25032        1178 NPS---AFLE---SKGYLN--I-RADKLII--LPKYSLFE---LENGRRRLLAS AGELQKGNELALPTQFMKFLYLA 1240

CFV16040        1178 NPS---AFLE---SKGYLN--I-RADKLII--LPKYSLFE---LENGRRRLLAS AGELQKGNELALPTQFMKFLYLA 1240

KLJ37842        1178 NPS---AFLE---SKGYLN--I-RADKLII--LPKYSLFE---LENGRRRLLAS AGELQKGNELALPTQFMKFLYLA 1240

KLJ72361        1178 NPS---AFLE---SKGYLN--I-RADKLII--LPKYSLFE---LENGRRRLLAS AGELQKGNELALPTQFMKFLYLA 1240

KLL20707        1192 NPS---AFLE---SKGYLN--I-RADKLII--LPKYSLFE---LENGRRRLLAS AGELQKGNELALPTQFMKFLYLA 1254

KLL42645        1178 NPS---AFLE---SKGYLN--I-RDDKLMI--LPKYSLFE---LENGRRRLLAS AGELQKGNELALPTQYMKFLYLA 1240

WP_047207273    1178 NPS---AFLE---SKGYLN--I-RADKLII--LPKYSLFE---LENGRRRLLAS AGELQKGNELALPTQFMKFLYLA 1240

WP_047209694    1178 NPS---AFLE---SKGYLN--I-RDDKLMI--LPKYSLFE---LENGRRRLLAS AGELQKGNELALPTQFMKFLYLA 1240

WP_050198062    1178 NPS---AFLE---SKGYLN--I-RADKLII--LPKYSLFE---LENGRRRLLAS AGELQKGNELALPTQFMKFLYLA 1240

WP_050201642    1178 NPS---AFLE---SKGYLN--I-RADKLII--LPKYSLFE---LENGRRRLLAS AGELQKGNELALPTQFMKFLYLA 1240

WP_050204027    1178 NPS---AFLE---SKGYLN--I-RDDKLMI--LPKYSLFE---LENGRRRLLAS AGELQKGNELALPTQYMKFLYLA 1240

WP_050881965    1178 NLS---AFLE---SKGYLN--I-RADKLII--LPKYSLFE---LENGRRRLLAS AGELQKGNELALPTQFMKFLYLA 1240

WP_050886065    1178 NPS---AFLE---SKGYLN--I-RADKLII--LPKYSLFE---LENGRRRLLAS AGELQKGNELALPTQFMKFLYLA 1240

AHN30376        1178 NPS---AFLE---SKGYLN--I-RTDKLII--LPKYSLFE---LENGRRRLLAS AGELQKGNELALPTQYMKFLYLA 1240

EAO78426        1178 NPS---AFLE---SKGYLN--I-RADKLII--LPKYSLFE---LENGRRRLLAS AGELQKGNELALPTQFMKFLYLA 1240

CCW42055        1178 NPS---AFLE---SKGYLN--I-RTDKLII--LPKYSLFE---LENGRRRLLAS AGELQKGNELALPTQFMKFLYLA 1240

WP_003041502    1186 DKR---AFLL---GKGYKD--I-K--KIIE--LPKYSLFE---LKDGSRRMLAS RGEIHKGNELFVPQKFTTLLYHA 1253

WP_037593752    1160 NPV---DFLE---QRGYRN--V-RLEKIIK--LPKYSLFE---LENKRRRLLAS ARELQKGNELVIPQRFTTLLYHS 1222
```

-continued

| | | | |
|---|---|---|---|
| WP_049516684 | 1160 | HPV---DFLE---QRGYRN--V-RLEKIIK--LPKYSLFE---LENKRRRLLAS ARELQKGNELVIPQRFTTLLYHS | 1222 |
| GAD46167 | 1159 | NPV---DFLE---QRGYRN--V-RLEKIIK--LPKYSLFE---LENKRRRLLAS ARELQKGNELVIPQRFTILLYHS | 1221 |
| WP_018363470 | 1191 | NPV---EFLK---NKGYQN--V-QEDKLMK--LPKYSLFE---FEGGRRRLLAS ATELQKGNEIMLSAHLVALLYHA | 1253 |
| WP_003043819 | 1186 | DPI---GFLE---AKGYKD--I-KKELIFK--LPKYSLFE---LENGRRRMLAS --ELQKANELVLPQHLVRLLYYT | 1248 |
| WP_006269658 | 1159 | NPV---DFLE---QRGYRN--V-RLEKIIK--LPKYSLFE---LENKRRRLLAS AKELQKGNELVIPQRFTTLLYHS | 1221 |
| WP_048800889 | 1179 | NPI---MFLE---SKGYRN--I-QKDKLIK--LPKYSLFE---FEGGRRRLLAS AVELQKGNEMVLPQYLNNLLYHA | 1241 |
| WP_012767106 | 1178 | NPL---KFIE---DKGYGN--V-QIDKCIK--LPKYSLFE---FENGTRRMLAS RGDLQKANEMFLPAKLVTLLY-- | 1245 |
| WP_014612333 | 1178 | NPL---KFIE---DKGYGN--V-QIDKCIK--LPKYSLFE---FENGTRRMLAS RGDLQKANEMFLPAKLVTLLY-- | 1245 |
| WP_015017095 | 1178 | NPL---KFIE---DKGYGN--V-QIDKCIK--LPKYSLFE---FENGTRRMLAS RGDLQKANEMFLPAKLVTLLY-- | 1245 |
| WP_015057649 | 1178 | NPL---KFIE---DKGYGN--V-QIDKCIK--LPKYSLFE---FENGTRRMLAS RGDLQKANEMFLPAKLVTLLY-- | 1245 |
| WP_048327215 | 1178 | NPL---KFIE---DKGYGN--V-QIDKCIK--LPKYSLFE---FENGTRRMLAS RGDLQKANEMFLPAKLVTLLY-- | 1245 |
| WP_049519324 | 1178 | NPL---KFIE---DKGYGN--V-QIDKCIK--LPKYSLFE---FENGTRRMLAS RGDLQKANEMFLPAKLVTLLY-- | 1245 |
| WP_012515931 | 1157 | NPV---VFLE---ARGYRE--I-QEHLIIK--LPKYSLFE---LENGRRRLLAS -SELQKGNELFLPVDYMTFLYLA | 1219 |
| WP_021320964 | 1157 | NPV---VFLE---AKGYRE--I-QEHLIIK--LPKYSLFE---LENGRRRLLAS -SELQKGNELFLPVDYMTFLYLA | 1219 |
| WP_037581760 | 1157 | NPV---VFLE---AKGYRE--I-QEHLIIK--LPKYSLFE---LENGRRRLLAS -SELQKGNELFLPVDYMTFLYLA | 1219 |
| WP_004232481 | 1189 | NPV---SFLE---KKGYHN--V-QEDKLIK--LPKYSLFE---FEGGRRRLLAS ATELQKGNEVVLPQYMVNLLYHS | 1251 |
| WP_009854540 | 1184 | NPV---EFLE---NKGYHN--I-REDKLIK--LPKYSLFE---FEGGRRRLLAS ASELQKGNEMVLPGYLVELLYHA | 1246 |
| WP_012962174 | 1185 | NPV---VFLE---KKGYQN--V-QEDNLIK--LPKYSLFE---FEGGRRRLLAS ASELQKGNEVVLSRHLVELLYHA | 1247 |
| WP_039695303 | 1186 | NPV---EFLE---NKGYHN--I-REDKLIK--LPKYSLFE---FEGGRRRLLAS ASELQKGNEMVLPGYLVELLYHA | 1248 |
| WP_014334983 | 1189 | NPV---SFLE---KKGYHN--V-QEDKLIK--LPKYSLFE---FEGGRRRLLAS ATELQKGNEVMLPAHLVELLYHA | 1251 |
| WP_003099269 | 1177 | DPI---AFLE---KKGYQD--I-QTSSIIK--LPKYSLFE---LENGRKRLLAS --ELQKGNELALPNKYVKFLYLA | 1239 |
| AHY15608 | 1177 | DPI---AFLE---KKGYQD--I-QTSSIIK--LPKYSLFE---LENGRKRLLAS --ELQKGNELALPNKYVKFLYLA | 1239 |
| AHY17476 | 1177 | DPI---AFLE---KKGYQD--I-QTSSIIK--LPKYSLFE---LENGRKRLLAS --ELQKGNELALPNKYVKFLYLA | 1239 |
| ESR09100 | 9 | DPI---AFLE---KKGYQD--I-QTSSIIK--LPKYSLFE---LENGRKRLLAS -KELQKGNELALPNKYVKFLYLA | 71 |
| AGM98575 | 1177 | DPI---AFLE---KKGYQD--I-QTSSIIK--LPKYSLFE---LENGRKRLLAS --ELQKGNELALPNKYVKFLYLA | 1239 |
| ALF27331 | 1159 | NPV---AFLE---RKGYRN--V-QEENIVK--LPKYSLFE---LENGRRRLLAS ARELQKGNEIVLPNHLGTMLYHA | 1221 |
| WP_018372492 | 1168 | EPEr---FLA---QKGFER--V-EKT--IK--LPKYSLFE---MEKGRRRLLAS SGELQKGNQVLLPEHLIRLLSYA | 1228 |
| WP_045618028 | 1189 | NPI---AYLE---ECGYKN--I-NPNLIIK--LPKYSLFE---FNNGQRRLLAS SIELQKGNELIVPYHFTALLYHA | 1251 |
| WP_045635197 | 1184 | NPI---TFLE---NKGYHN--V-RKENILC--LPKYSLFE---LENGRRRLLAS AKELQKGNEIVLPVYLTTLLYHS | 1246 |
| WP_002263549 | 1159 | DPV---AFLE---RKGYRN--V-QEENIIK--LPKYSLFK---LENGRKRLLAS ARELQKGNEIVLPNHLGTLLYHA | 1221 |
| WP_002263887 | 1159 | DPV---AFLE---RKGYRN--V-QEENIIK--LPKYSLFK---LENGRKRLLAS ARELQKGNEIVLPNHLGTLLYHA | 1221 |
| WP_002264920 | 1159 | DPV---AFLE---RKGYRN--V-QEENIIK--LPKYSLFK---LENGRKRLLAS ARELQKGNEIVLPNHLGTLLYHA | 1221 |
| WP_002269043 | 1159 | DPV---AFLE---RKGYRN--V-QEENIIK--LPKYSLFK---LENGRKRLLAS ARELQKGNEIVLPNHLGTLLYHA | 1221 |
| WP_002269448 | 1159 | DPV---AFLE---RKGYRN--V-QEENIIK--LPKYSLFK---LENGRKRLLAS ARELQKGNEIVLPNHLGTLLYHA | 1221 |
| WP_002271977 | 1159 | DPV---AFLE---RKGYRN--V-QEENIIK--LPKYSLFK---LENGRKRLLAS ARELQKGNEIVLPNHLGTLLYHA | 1221 |
| WP_002272766 | 1159 | DPV---AFLE---RKGYRN--V-QEENIIK--LPKYSLFK---LENGRKRLLAS ARELQKGNEIVLPNHLGTLLYHA | 1221 |
| WP_002273241 | 1159 | DPV---AFLE---RKGYRN--V-QEENIIK--LPKYSLFK---LENGRKRLLAS ARELQKGNEIVLPNHLGTLLYHA | 1221 |
| WP_002275430 | 1159 | DPV---AFLE---RKGYRN--V-QEENIIK--LPKYSLFK---LENGRKRLLAS ARELQKGNEIVLPNHLGTLLYHA | 1221 |
| WP_002276448 | 1159 | DPV---AFLE---RKGYRN--V-QEENIIK--LPKYSLFK---LENGRKRLLAS ARELQKGNEIVLPNHLGTLLYHA | 1221 |
| WP_002277050 | 1167 | NPV---KFLK---DKGYQQ--I-EKNNFVK--LPKYTLVD---IGNGIKRLWAS SKEVHKGNQLVVSKKSQDLLYHA | 1229 |

-continued

```
WP_002277364  1159 DPV---AFLE---RKGYRN--V-QEENIIK--LPKYSLFK---LENGRKRLLAS ARELQKGNEIVLPNHLGTLLYHA  1221
WP_002279025  1159 DPV---AFLE---RKGYRN--V-QEENIIK--LPKYSLFK---LENGRKRLLAS ARELQKGNEIVLPNHLGTLLYHA  1221
WP_002279859  1159 DPV---AFLE---RKGYRN--V-QEENIIK--LPKYSLFK---LENGRKRLLAS ARELQKGNEIVLPNHLGTLLYHA  1221
WP_002280230  1159 DPV---AFLE---RKGYRN--V-QEENIIK--LPKYSLFK---LENGRKRLLAS ARELQKGNEIVLPNHLGTLLYHA  1221
WP_002281696  1159 DPV---AFLE---RKGYRN--V-QEENIIK--LPKYSLFK---LENGRKRLLAS ARELQKGNEIVLPNHLGTLLYHA  1221
WP_002282247  1167 NPV---KFLK---DKGYQQ--I-EKNNFVK--LPKYTLVD---IGNGIKRLWAS SKEVHKGNQLVVSKKSQDLLYHA  1229
WP_002282906  1159 DPV---AFLE---RKGYRN--V-QEENIIK--LPKYSLFK---LENGRKRLLAS ARELQKGNEIVLPNHLGTLLYHA  1221
WP_002283846  1159 DPV---AFLE---RKGYRN--V-QEENIIK--LPKYSLFK---LENGRKRLLAS ARELQKGNEIVLPNHLGTLLYHA  1221
WP_002287255  1159 DPV---AFLE---RKGYRN--V-QEENIIK--LPKYSLFK---LENGRKRLLAS ARELQKGNEIVLPNHLGTLLYHA  1221
WP_002288990  1159 DPV---AFLE---RKGYRN--V-QEENIIK--LPKYSLFK---LENGRKRLLAS ARELQKGNEIVLPNHLGTLLYHA  1221
WP_002289641  1159 DPV---AFLE---RKGYRN--V-QEENIIK--LPKYSLFK---LENGRKRLLAS ARELQKGNEIVLPNHLGTLLYHA  1221
WP_002290427  1159 DPV---AFLE---RKGYRN--V-QEENIIK--LPKYSLFK---LENGRKRLLAS ARELQKGNEIVLPNHLGTLLYHA  1221
WP_002295753  1159 DPI---AFLE---RKGYRN--V-QEENIIK--LPKYSLFK---LENGRKRLLAS ARELQKGNEIVLPNHLGTLLYHA  1221
WP_002296423  1159 DPV---AFLE---RKGYRN--V-QEENIIK--LPKYSLFK---LENGRKRLLAS ARELQKGNEIVLPNHLGTLLYHA  1221
WP_002304487  1173 DPV---AFLE---RKGYRN--V-QEENIIK--LPKYSLFK---LENGRKRLLAS ARELQKGNEIVLPNHLETLLYHA  1235
WP_002305844  1159 DPV---AFLE---RKGYRN--V-QEENIIK--LPKYSLFK---LENGRKRLLAS ARELQKGNEIVLPNHLGTLLYHA  1221
WP_002307203  1159 DPI---AFLE---RKGYRN--V-QEENIIK--LPKYSLFK---LENGRKRLLAS ARELQKGNEIVLPNHLGTLLYHA  1221
WP_002310390  1159 DPV---AFLE---RKGYRN--V-QEENIIK--LPKYSLFK---LENGRKRLLAS ARELQKGNEIVLPNHLGTLLYHA  1221
WP_002352408  1159 DPV---AFLE---RKGYRN--V-QEENIIK--LPKYSLFK---LENGRKRLLAS ARELQKGNEIVLPDHLGTLLYHA  1221
WP_012997688  1159 DPV---AFLE---RKGYRN--V-QEENIIK--LPKYSLFK---LENGRKRLLAS ARELQKGNEIVLPNHLGTLLYHA  1221
WP_014677909  1159 DPV---AFLE---RKGYRN--V-QEENIIK--LPKYSLFK---LENGRKRLLAS ARELQKGNEIVLPNHLGTLLYHA  1221
WP_019312892  1159 DPV---AFLE---RKGYRN--V-QEENIIK--LPKYSLFK---LENGRKRLLAS ARELQKGNEIVLPNHLGTLLYHA  1221
WP_019313659  1159 DPV---AFLE---RKGYRN--V-QEENIIK--LPKYSLFK---LENGRKRLLAS ARELQKGNEIVLPNHLGTLLYHA  1221
WP_019314093  1159 DPI---AFLE---RKGYRN--V-QEENIIK--LPKYSLFK---LENGRKRLLAS ARELQKGNEIVLPNHLGTLLYHA  1221
WP_019315370  1159 DPV---AFLE---RKGYRN--V-QEENIIK--LPKYSLFK---LENGRKRLLAS ARELQKGNEIVLPNHLGTLLYHA  1221
WP_019803776  1159 DPV---AFLE---RKGYRN--V-QEENIIK--LPKYSLFK---LENGRKRLLAS ARELQKGNEIVLPNHLGTLLYHA  1221
WP_019805234  1159 DPV---AFLE---RKGYRN--V-QEENIIK--LPKYSLFK---LENGRKRLLAS ARELQKGNEIVLPNHLGTLLYHA  1221
WP_024783594  1159 DPV---AFLE---RKGYRN--V-QEENIIK--LPKYSLFK---LENGRKRLLAS ARELQKGNEIVLPNHLGTLLYHA  1221
WP_024784288  1167 NPV---KFLK---DKGYQQ--I-EKNNFVK--LPKYTLVD---IGNGIKRLWAS SKEVHKGNQLVVSKKSQDLLYHA  1229
WP_024784666  1159 DPV---AFLE---RKGYRN--V-QEENIIK--LPKYSLFK---LENGRKRLLAS ARELQKGNEIVLPNHLGTLLYHA  1221
WP_024784894  1159 DPV---AFLE---RKGYRN--V-QEENIIK--LPKYSLFK---LENGRKRLLAS ARELQKGNEIVLPNHLGTLLYHA  1221
WP_024786433  1167 NPV---KFLK---DKGYQQ--I-EKNNFVK--LPKYTLVD---IGNGIKRLWAS SKEVHKGNQLVVSKKSQDLLYHA  1229
WP_049473442  1159 DPV---AFLE---RKGYRN--V-QEENIIK--LPKYSLFK---LENGRKRLLAS ARELQKGNEIVLPNHLGTLLYHA  1221
WP_049474547  1159 DPV---AFLE---RKGYRN--V-QEENIIK--LPKYSLFK---LENGRKRLLAS ARELQKGNEIVLPNHLGTLLYHA  1221
EMC03581      1152 DPV---AFLE---RKGYRN--V-QEENIIK--LPKYSLFK---LENGRKRLLAS ARELQKGNEIVLPNHLGTLLYHA  1214
WP_000428612  1187 SPI---AFLE---NKGYHN--V-RKENILC--LPKYSLFE---LKNGRRRMLAS AKELQKGNEIVLPVHLTTLLYHA  1249
WP_000428613  1185 NPI---TFLE---NKGYHN--V-RKENILC--LPKYSLFE---LENGRRRLLAS AKELQKGNEIVLPVYLTTLLYHS  1247
WP_049523028  1180 NPV---AFLE---GKGYQN--V-VEENIIR--LPKYSLFE---LENGRRRMLAS AKELQKGNEMVLPSYLIALLYHA  1242
WP_003107102  1146 DRI---TFLE---KKGYQD--I-QESLIIK--LPKFSLFE---LENGRKRLLAS --ELQKGNELSLPNKYIQFLYLA  1208
WP_054279288  1179 NPI---AFLE---SKGYHD--I-QEHLMIT--LPKYSLFE---LENGRRRLLAS --ELQKGNEMVLPQHLVTFLYRV  1241
WP_049531101  1189 NPT---AYLE---EYGYKN--I-NPNLIIK--LPKYSLFK---FNDGQRRLLAS SIELQKGNELILPYHFTTLLYHA  1251
```

-continued

```
WP_049538452   1189 NPI---AYLE---ECGYKN--I-NPNLIIK--LPKYSLFE---FNGGQRRLLAS SIELQKGNELILPYHFTALLYHT 1251
WP_049549711   1191 NPI---AYLE---ECGYKN--I-NPNLIIK--LPKYSLFE---ENGGQRRLLAS SIELQKGNELILPYHFTALLYHA 1253
WP_007896501   1183 DNI---AFLE---KKGYQD--I-QEKLLIK--LPKYSLFE---LENGRRRLLAS --EFQKGNELALSGKYMKFLYLA 1245
EFR44625       1135 DNI---AFLE---KKGYQD--I-QEKLLIK--LPKYSLFE---LENGRRRLLAS --EFQKGNELALSGKYMKFLYLA 1197
WP_002897477   1184 NPI---TFLE---NKGYHN--V-RKENILC--LPKYSLFE---LENGRRRLLAS AKELQKGNEIVLPVCLTTLLYHS 1246
WP_002906454   1190 NPV---TYLE---ECGYKN--I-NSNLIIK--LPKYSLFE---FNDGQRRLLAS SIELQKGNELILPYHLTALLYHA 1252
WP_009729476   1185 NPI---AFLE---NKGYHN--V-CKENILC--LPKYSLFE---LENGRRRLLAS AKELQKCNEIVLPVYLTTLLYHS 1247
CQR24647       1175 NSV---TFLE---EKGYRN--I-RENTIIK--FPKYSLFE---LENGRRRLLAS AIELQKGNEMFLPQQFVNLLYHA 1237
WP_000066813   1189 NPI---TFLE---NKGYHN--V-RKENILC--LPKYSLFE---LESGRRRMLAS AKELQKGNEIVLPVYLTTLLYHS 1251
WP_009754323   1185 NPI---TFLE---NKGYHN--V-RKENILC--LPKYSLFE---LENGRRRLLAS AKELQKGNEIVLPVYLTTLLYHS 1247
WP_044674937   1178 NPI---EFLE---HKGYKN--I-LEKNIIK--LPKYSLFE---LENGRRRLLAS AKELQKGNEMILPPHLVTLLYHS 1240
WP_044676715   1180 NPI---EFLE---HKGYKN--I-LEKNIIK--LPKYSLFE---LENGRRRLLAS AKELQKGNEMILPPHLVTLLYHS 1242
WP_044680361   1180 NPI---EFLE---HKGYKN--I-LEKNIIK--LPKYSLFE---LENGRRRLLAS AKELQKGNEMILPPHLVTLLYHS 1242
WP_044681799   1178 NPI---EFLE---HKGYKN--I-LEKNIIK--LPKYSLFE---LENGRRRLLAS AKELQKGNEMILPPHLVTLLYHS 1240
WP_049533112   1186 DKR---AFLL---GKGYKD--I-K--KIIE--LPKYSLFE---LKDGSRRMLAS RGEIHKGNELFVPQKFTTLLYHA 1253
WP_029090905   1118 SETslqAYIA---EQIKSE--VeILN----grILKYQLIS----NNGNRLYIAG -SERHNARQLIVSDEAAKVIWLI 1181
WP_006506696   1150 EKI---NYIE--eKEGLSD--VrIIK---Dn-IPVNQMIEm----DGGEYLLTS --EYVNARQLVLNEKQCALIADI 1211
AIT42264       1177 NPI---DFLE---AKGYKE--V-KKDLIIK--LPKYSLFE---LENGRKRMLAS -GELQKGNELALPSKYVNFLYLA 1239
WP_034440723   1150 QTT---EYLG---KIGFNK--AsIIN---S--FKNYTLFE---LENGSRRMIVG KGELQKGNQMYLPQNLLEFVYHL 1217
AKQ21048       1177 NPI---DFLE---AKGYKE--V-KKDLIIK--LPKYSLFE---LENGRKRMLAS -GELQKGNELALPSKYVNFLYLA 1239
WP_004636532   1151 HPT---AYLE---EAGYNN--P-TV--LHE--LFKYQLFE---LEDGSRRMIAS AKEFQKGNQMVLPLELVELLYHA 1211
WP_002364836   1157 NPI---LFLE---EKGFLR--P-RV--LMK--LPKYTLYE---FPEGRRRLLAS AKEAQKGNQMVLPEHLLTLLYHA 1217
WP_016631044   1108 NPI---LFLE---EKGFLR--P-RV--LMK--LPKYTLYE---FPEGRRRLLAS AKEAQKGNQMVLPEHLLTLLYHA 1168
EMS75795        893 DPI---GFLS---NKGYSN--V-TKF--IK--LSKYTLYE---LENGRRRMVAS -KEAQKANSFILPEKLVTLLYHA  953
WP_002373311   1157 NPI---LFLE---EKGFLR--P-RV--LMK--LPKYTLYE---FPEGRRRLLAS AKEAQKGNQMVLPEHLLTLLYHA 1217
WP_002378009   1157 NPI---LFLE---EKGFLR--P-RV--LMK--LPKYTLYQ---FPEGRRRLLAS AKEAQKGNQMVLPEHLLTLLYHA 1217
WP_002407324   1157 NPI---LFLE---EKGFLR--P-RV--LMK--LPKYTLYE---FPEGRRRLLAS AKEAQKGNQMVLPEHLLTLLYHA 1217
WP_002413717   1157 NPI---LFLE---EKGFLR--P-RV--LMK--LPKYTLYE---FPEGRRRLLAS AKEAQKGNQMVLPEHLLILLYHA 1217
WP_010775580   1159 NPI---LFLE---EKGFLR--P-RV--LMK--LPKYTLYE---FPEGRRRLLAS AKEAQKGNQMVLPEHLLTLLYHA 1219
WP_010818269   1157 NPI---LFLE---EKGFLR--P-RV--LMK--LPKYTLYE---FPEGRRRLLAS AKEAQKGNQMVLPEHLLTLLYHA 1217
WP_010824395   1157 NPI---LFLE---EKGFLR--P-RV--LMK--LPKYTLYE---FPEGRRRLLAS AKEAQKGNQMVLPEHLLTLLYHA 1217
WP_016622645   1157 NPI---LFLE---EKGFLR--P-RV--LMK--LPKYTLYE---FPEGRRRLLAS AKEAQKGNQMVLPEHLLTLLYHA 1217
WP_033624816   1157 NPI---LFLE---EKGFLR--P-RV--LMK--LPKYTLYE---FPEGRRRLLAS AKEAQKGNQMVLPERLLTLLYHA 1217
WP_033625576   1157 NPI---LFLE---EKGFLR--P-RV--LMK--LPKYTLYE---FPEGRRRLLAS AKEAQKGNQMVLPEHLLTLLYHA 1217
WP_033789179   1157 NPI---LFLE---EKGFLR--P-RV--LMK--LPKYTLYE---FPEGRRRLLAS AKEAQKGNQMVLPEHLLTLLYHA 1217
WP_002310644   1159 SPV---LFLK---NKGYEQ--A-EIE--MK--LPKYALFE---LENGRKRMVAS -KEAQKANSFLLPEHLVTLLYHA 1219
WP_002312694   1160 SPV---LFLK---NKGYEQ--A-EIE--MK--LPKYALFE---LENGRKRMVAS -KEAQKANSFLLPEHLVTLLYHA 1220
WP_002314015   1160 SPV---LFLK---NKGYEQ--A-EIE--MK--LPKYALFE---LENGRKRMVAS -KEAQKANSELLPEHLVTLLYHA 1220
WP_002320716   1160 SPV---LFLK---NKGYEQ--A-EIE--MK--LPKYALFE---LENGRKRMVAS -KEAQKANSFLLPEHLILLYHA 1220
WP_002330729   1159 SPV---LFLK---NKGYEQ--A-EIE--MK--LPKYALFE---LENGRKRMVAS -KEAQKANSFLLPEHLVTLLYHA 1219
```

-continued

```
WP_002335161   1160 SPV---LFLK---NKGYEQ--A-EIE--MK--LPKYALFE---LENGRKRMVAS -KEAQKANSFLLPEHLVTLLYHA 1220
WP_002345439   1160 SPV---LFLK---NKGYEQ--A-EIE--MK--LPKYALFE---LENGRKRMVAS -KEAQKANSELLPEHLVTLLYHA 1220
WP_034867970   1150 DPT---TFLK---EKGFPQ--V-TEF--IK--LPKYTLFE---FDNGRRRFLAS -KESQKGNPFILSDQLVTLLYHA 1210
WP_047937432   1160 SPV---LFLK---NKGYEQ--A-EIE--MK--LPKYALFE---LENGRKRMVAS -KEAQKANSFLLPEHLVTLLYHA 1220
WP_010720994   1150 DPT---TFLK---DKGFPQ--V-TEF--IK--LPKYTLFE---FDNGRRRFLAS -KESQKGNPFILSDQLVTLLYHA 1210
WP_010737004   1150 DPT---TFLK---EKGFPQ--V-TEF--IK--LPKYTLFE---FDNGRRRFLAS -KESQKGNPFILSDQLVTLLYHA 1210
WP_034700478   1150 DPT---TFLK---DKGFPH--V-TEF--IK--LPKYTLFE---FDNGRRRFLAS -KESQKGNPFILSDQLVTLLYHA 1210
WP_007209003   1148 NPIl---YLS---KKDYHN---pKVEAl----LPKYSLFE---FENGRRRMVAS -SETQKGNQLIIPGHLMELLYHS 1208
WP_023519017   1144 DPR---EFLK---TKGYEG--V-KQW--LI--LPKYILFE---AQGGYRRMIAS -QETQKANSLILPENLVTLLYHA 1204
WP_010770040   1155 DPV---SLLE---EKGYAN--P-EV--LIH--LPKYTLYE---LENGRRLLAS ANEAQKGNQLVLPASLVTLLYHA 1215
WP_048604708   1152 NER---EFLK---NKGYQN--P-QI--CMK--LPKYSLYE---FDDGRRLLAS AKEAQKGNQMVLPAHLVTFLYHA 1212
WP_010750235   1153 DPI---SFLI---EKGYSN--V-NQF--IK--LPKYTLFE---LANGQRRMLAS -QELQKANSFILPEKLVTLLYHA 1213
AII16583       1216 NPI---DFLE---AKGYKE--V-KKDLIIK--LPKYSLFE---LENGRKRMLAS -GELQKGNELALPSKYVNFLYLA 1278
WP_029073316   1165 TKI---NYIK--eSEGLEE--VkIIK---E--ILKNQLIEi----NGGLFYVTS --EIVNARQLILDENCTRIIDGI 1225
WP_031589969   1165 IKI---NYLK--qAEDLEE--VqIGK---E--ILKNQLIEk----DGGLYYIVA --EIINAKQLILNESQTKLVCEI 1225
KDA45870       1139 DPT---AYLA---SRGYTNvtNsFIL-------PKYSLLEd---PEGRRRYLAS -KEFQKANELILPQHLVELLYWV 1199
WP_039099354   1171 QKI--spQFTKv---KKQKGtiV-KVVEDFEv-IAPHILINqrfFDNGQELTLGS ----HNEQELILDKTAVKLLNGA 1241
AKP02966       1173 KTL--qNWLE---ENVKHKksIqIIK---Nn-VPIGQIIY------SKKVGLLS -REIANRQQLILPPEHSALLRIL 1237
WP_010991369   1155 DEK---AFLE---EQGYRQ--P-KV--LAK--LPKYTLYE---CEEGRRRMLAS ANEAQKGNQQVLPNHLVTLLHHA 1215
WP_033838504   1155 DEK---AFLE---EQGYRQ--P-KV--LAK--LPKYTLYE---CEEGRRRMLAS ANEAQKGNQQVLPNHLVTLLHHV 1215
EHN60060       1158 DEK---AFLE---EQGYRQ--P-KV--LAK--LPKYTLYE- -CEEGRRRMLAS ANEAQKGNQQVLPNHLVILLHHV 1218
EFR89594        924 DEK---AFLE---EQGYRQ--P-KV--LAK--LPKYTLYE---CEEGRRRMLAS ANEAQKGNQQVLPNHLVILLHHA  984
WP_038409211   1155 DQK---AFLE---EKGYYS--P-KV--LTK--IPKYTLYE---CENGRRRMLGS ANEAQKGNQMVLPNHLMTLLYHA 1215
EFR95520        774 DQK---AFLE---EKGYYS--P-KV--LTK--IPKYTLYE- -CENGRRRMLGS ANEAQKGNQMVLPNHLMTLLYHA  834
WP_003723650   1155 DEE---AFLE---EKGYRH--P-KV--LTK--LPKYTLYE---CEKGRRRMLAS ANEAQKGNQLVLSNHLVSLLYHA 1215
WP_003727705   1155 DEE---AFLE---EKGYHQ--P-KV--LTK--LPKYTLYE---CEKGRRRMLSS ANEAQKGNQLVLSNHLVSLLYHA 1215
WP_003730785   1155 DEE---AFLE---EKGYHQ--P-KV--LTK--LPKYTLYE---CEKGRRRMLSS ANEAQKGNQLVLSNHLVSLLYHA 1215
WP_003733029   1155 DEK---TFLE---EKGYHQ--P-KV--LIK--VPKYTLYE---CKNGRRRMLGS ANEAHKGNQMLLPNHLMALLYHA 1215
WP_003739838   1155 DEK---SFLE---KQGYRQ--P-KV--LTK--LPKYTLYE---CENGRRRMLAS ANEAQKGNQQVLKGQLITLLHHA 1215
WP_014601172   1155 DEE---AFLE---EKGYRH--P-KV--LTK--LPKYTLYE---CEKGRRRMLAS ANEAQKGNQLVLSNHLVSLLYHA 1215
WP_023548323   1155 DEK---VFLE---GKGYHQ--P-KV--LTK--LPKYALYE---CENGRRRMLGS ANEVHKGNQMLLPNHLMTLLYHA 1215
WP_031665337   1155 DEE---AFLE---EKGYRH--P-KV--LTK--LPKYTLYE---CEKGRRRMLAS ANEAQKGNQLVLSNHLVSLLYHA 1215
WP_031669209   1155 DEK---TFLE---EKGYHQ--P-KV--LIK--VPKYTLYE---CENGRRRMLGS ANEAHKGNQMLLPNHLMALLYHA 1215
WP_033920898   1155 DEK--VFLE---GKGYHQ--P-KV--LTK--LPKYALYE- -CENGRRRMLGS ANEVHKGNQMLLPNHLMTLLYHA 1215
AKI42028       1158 DEE---AFLE---EKGYRH--P-KV--LTK--LPKYTLYE- -CEKGRRRMLAS ANEAQKGNQLVLSNHLVSLLYHA 1218
AKI50529       1158 DEK---VFLE---GKGYHQ--P-KV--LTK--LPKYALYE- -CENGRRRMLGS ANEVHKGNQMLLPNHLMTLLYHA 1218
EFR83390        603 DEE---AFLE---EKGYRH--P-KV--LTK--LPKYTLYE- -CEKGRRRMLAS ANEAQKGNQLVLSNHLVSLLYHA  663
WP_046323366   1155 DQK---EFLE---GKGYRN--P-KV--ITK--IPKYTLYE---CENGRRRMLGS ANEAQKGNQMVLPNHLMTLLYHA 1215
AKE81011       1193 NPI---DFLE---AKGYKE--V-KKDLIIK--LPKYSLFE---LENGRKRMLAS -GELQKGNELALPSKYVNFLYLA 1255
CUO82355       1154 EQI---EYVE--kEEKLSD--VkIIK---Nn-IPLNQLIEi----DGRQYLLTS --ECVNAMQLVLNEEQCKLIADI 1215
WP_033162887   1155 EQL---SYIAspeHEDLID--VrIVK---E--ILKNQLIEi----DGGLYYVTS --EYVTARQLSLNEQSCKLISEI 1217
```

-continued

```
AGZ01981      1210 NPI---DFLE---AKGYKE--V-KKDLIIK--LPKYSLFE---LENGRKRMLAS -GELQKGNELALPSKYVNFLYLA 1272
AKA60242      1177 NPI---DFLE---AKGYKE--V-KKDLIIK--LPKYSLFE---LENGRKRMLAS -GELQKGNELALPSKYVNFLYLA 1239
AKS40380      1177 NPI---DFLE---AKGYKE--V-KKDLIIK--LPKYSLFE---LENGRKRMLAS -GELQKGNELALPSKYVNFLYLA 1239
4UN5_B        1181 NPI---DFLE---AKGYKE--V-KKDLIIK--LPKYSLFE---LENGRKRMLAS -GELQKGNELALPSKYVNFLYLA 1243
WP_010922251  1240 SHYEKLKgSPEDnEQKQL--FVEQHKHYLDEIIEQISEFSKRVILAD--ANLDKVL-S AYN-KH---RDKPIREq- 1305
WP_039695303  1249 HRAD----NFNS-TEYLN--YVSEHKKEFEKVLSCVEDFANLYVDVE--KNLSKIR-A VAD-SM---DNFSIEE-- 1308
WP_045635197  1247 KNVH----KLDE-PGHLE--YIQKHRNEFKDLLNLVSEFSQKYVLAD--ANLEKIK-S LYA-DN---EQADIEI-- 1306
5AXW_A         979 GELYRVIgVNNDlLNRIE---VNMIDITYREYLENMNDKRPPRIIKTiaSKTQSIK-K LYEvKSk--KHPQIIKkg 1056
WP_009880683   924 SHYEKLKgSPEDnEQKQL--FVEQHKHYLDEIIEQISEFSKRVILAD--ANLDKVL-S AYN-KH---RDKPIREq-  989
WP_010922251  1240 SHYEKLKgSPEDnEQKQL--FVEQHKHYLDEIIEQISEFSKRVILAD--ANLDKVL-S AYN-KH---RDKPIREq- 1305
WP_011054416  1240 SHYEKLKgSPEDnEQKQL--FVEQHKHYLDEIIEQISEFSKRVILAD--ANLDKVL-S AYN-KH---RDKPIREq- 1305
WP_011284745  1240 SHYEKLKgSPEDnEQKQL--FVEQHKHYLDEIIEQISEFSKRVILAD--ANLDKVL-S AYN-KH---RDKPIREq- 1305
WP_011285506  1240 SHYEKLKgSPEDnEQKQL--FVEQHKHYLDEIIEQISEFSKRVILAD--ANLDKVL-S AYN-KH---RDKPIREq- 1305
WP_011527619  1240 SHYEKLKgSPEDnEQKQL--FVEQHKHYLDEIIEQISEFSKRVILAD--ANLDKVL-S AYN-KH---RDKPIREq- 1305
WP_012560673  1240 SHYEKLKgSPEDnEQKQL--FVEQHKHYLDEIIEQISEFSKRVILAD--ANLDKVL-S AYN-KH---RDKPIREq- 1305
WP_014407541  1239 SHYEKLKgSPEDnEQKQL--FVEQHKHYLDEIIEQISEFSKRVILAD--ANLDKVL-S AYN-KH---RDKPIREq- 1304
WP_020905136  1240 SHYEKLKgSPEDnEQKQL--FVEQHKHYLDEIIEQISEFSKRVILAD--ANLDKVL-S AYN-KH---RDKPIREq- 1305
WP_023080005  1239 SHYEKLKgSPEDnEQKQL--FVEQHKHYLDEIIEQISEFSKRVILAD--ANLDKVL-S AYN-KH---RDKPIREq- 1304
WP_023610282  1239 SHYEKLKgSPEDnEQKQL--FVEQHKHYLDEIIEQISEFSKRVILAD--ANLDKVL-S AYN-KH---RDKPIREq- 1304
WP_030125963  1240 SHYEKLKgSPEDnEQKQL--FVEQHKHYLDEIIEQISEFSKRVILAD--ANLDKVL-S AYN-KH---RDKPIREq- 1305
WP_030126706  1240 SHYEKLKgSPEDnEQKQL--FVEQHKHYLDEIIEQISEFSKRVILAD--ANLDKVL-S AYN-KH---RDKPIREq- 1305
WP_031488318  1240 SHYEKLKgSPEDnEQKQL--FVEQHKHYLDEIIEQISEFSKRVILAD--ANLDKVL-S AYN-KH---RDKPIREq- 1305
WP_032460140  1240 SHYEKLKgSPEDnEQKQL--FVEQHKHYLDEIIEQISEFSKRVILAD--ANLDKVL-S AYN-KH---RDKPIREq- 1305
WP_032461047  1240 SHYEKLKgSPEDnEQKQL--FVEQHKHYLDEIIEQISEFSKRVILAD--ANLDKVL-S AYN-KH---RDKPIREq- 1305
WP_032462016  1240 SHYEKLKgSPEDnEQKQL--FVEQHKHYLDEIIEQISEFSKRVILAD--ANLDKVL-S AYN-KH---RDKPIREq- 1305
WP_032462936  1240 SHYEKLKgSPEDnEQKQL--FVEQHKHYLDEIIEQISEFSKRVILAD--ANLDKVL-S AYN-KH---RDKPIREq- 1305
WP_032464890  1240 SHYEKLKgSPEDnEQKQL--FVEQHKHYLDEIIEQISEFSKRVILAD--ANLDKVL-S AYN-KH---RDKPIREq- 1305
WP_033888930  1065 SHYEKLKgSPEDnEQKQL--FVEQHKHYLDEIIEQISEFSKRVILAD--ANLDKVL-S AYN-KH---RDKPIREq- 1130
WP_038431314  1240 SHYEKLKgSPEDnEQKQL--FVEQHKHYLDEIIEQISEFSKRVILAD--ANLDKVL-S AYN-KH---RDKPIREq- 1305
WP_038432938  1239 SHYEKLKgSPEDnEQKQL--FVEQHKHYLDEIIEQISEFSKRVILAD--ANLDKVL-S AYN-KH---RDKPIREq- 1304
WP_038434062  1240 SHYEKLKgSPEDnEQKQL--FVEQHKHYLDEIIEQISEFSKRVILAD--ANLDKVL-S AYN-KH---RDKPIREq- 1305
BAQ51233      1151 SHYEKLKgSPEDnEQKQL--FVEQHKHYLDEIIEQISEFSKRVILAD--ANLDKVL-S AYN-KH---RDKPIREq- 1216
KGE60162       415 SHYEKLKgSPEDnEQKQL--FVEQHKHYLDEIIEQISEFSKRVILAD--ANLDKVL-S AYN-KH---RDKPIREq-  480
KGE60856       178 SHYEKLKgSPEDnEQKQL--FVEQHKHYLDEIIEQISEFSKRVILAD--ANLDKVL-S AYN-KH---RDKPIREq-  243
WP_002989955  1240 SHYEKLKgSPEDnEQKQL--FVEQHKHYLDEIIEQISEFSKRVILAD--ANLDKVL-S AYN-KH---RDKPIREq- 1305
WP_003030002  1222 YQIE----KNYE-PEHRE--YVEKHKDEFKELLEYISVFSRKYVLAD--NNLTKIE-M LFS-KN---KDAEVSS-- 1281
WP_003065552  1250 QRIN----SFNS-TKYLD--YVSAHKKEFEKVLSCVEDFANLYVDVE--KNLSKIR-A VAD-SM---DNFSIEE-- 1309
WP_001040076  1241 SRYNESKgKPEEiEKKQE--FVNQHVSYFDDIFQIINDFSKRVILAD--ANLEKIN-R LYQ-DNk--ENIPVDE-- 1306
WP_001040078  1249 SRYNESKgKPEEiEKKQE--FVNQHVSYFDDILQLINDFSKRVILAD--ANLEKIN-K LYQ-DNK--ENISVDE-- 1314
WP_001040080  1241 SRYNESKgKPEEiEKKQE--FVNQHVSYFDDILQLINDFSKRVILAD--ANLEKIN-K LYQ-DNk--ENISVDE-- 1306
```

```
                      -continued
WP_001040081 1241 SRYNESKgKPEEiEKKQE--FVNQHVSYFDDILQLINDFSKRVILAD--ANLEKIN-K LYQ-DNk--ENISVDE-- 1306
WP_001040083 1241 SRYNESKgKPEEiEKKQE--FVNQHVSYFDDILQLINDFSKRVILAD--ANLEKIN-K LYQ-DNk--ENISVDE-- 1306
WP_001040085 1241 SRYNESKgKPEEiEKKQE--FVNQHVSYFDDILQLINDFSKRVILAD--ANLEKIN-K LYQ-DNk--ENISVDE-- 1306
WP_001040087 1241 SRYNESKgKPEEiEKKQE--FVNQHVSYFDDILQLINDFSKRVILAD--ANLEKIN-K LYQ-DNk--ENISVDE-- 1306
WP_001040088 1241 SRYNESKgKPEEiEKKQE--FVNQHVSYFDDILQLINDFSKRVILAD--ANLEKIN-K LYQ-DNk--ENISVDE-- 1306
WP_001040089 1241 SRYNESKgKPEEiEKKQE--FVNQHVSYFDDILQLINDFSKRVILAD--ANLEKIN-K LYQ-DNk--ENISVDE-- 1306
WP_001040090 1241 SRYNESKgKPEEiEKKQE--FVNQHVSYFDDILQLINDFSKRVILAD--ANLEKIN-K LYQ-DNk--ENISVDE-- 1306
WP_001040091 1241 SRYNESKgKPEEiEKKQE--FVNQHVSYFDDILQLINDFSKRVILAD--ANLEKIN-K LYQ-DNk--ENISVDE-- 1306
WP_001040092 1241 SRYNESKgKPEEiEKKQE--FVNQHISYFDDILQLINDFSKRVILAD--ANLEKIN-K LYS-DNk--DNTPVDE-- 1306
WP_001040094 1241 SRYNELKgKPEEiEQKQE--FVVQHVSYFDDILQIINDFSNRVILAD--ANLEKIN-K LYQ-DNk--ENIPVDE-- 1306
WP_001040095 1241 SRYNELKgKPEEiEQKQE--FVVQHVSYFDDILQIINDFSNRVILAD--ANLEKIN-K LYQ-DNk--ENIPVDE-- 1306
WP_001040096 1241 SRYNELKgKPEEiEQKQE--FVVQHVSYFDDILQIINDFSNRVILAD--ANLEKIN-K LYQ-DNk--ENIPVDE-- 1306
WP_001040097 1241 SRYNELKgKPEEiEQKQE--FVVQHVSYEDDILQIINDFSNRVILAD--ANLEKIN-K LYQ-DNk--ENIPVDE-- 1306
WP_001040098 1241 SRYNELKgKPEEiEQKQE--FVVQHVSYEDDILQIINDFSNRVILAD--ANLEKIN-K LYQ-DNk--ENIPVDE-- 1306
WP_001040099 1241 SRYNELKgKPEEiEQKQE--FVVQHVSYFDDILQIINDFSNRVILAD--ANLEKIN-K LYQ-DNk--ENIPVDE-- 1306
WP_001040100 1241 SRYNELKgKPEEiEQKQE--FVVQHVSYEDDILQIINDFSNRVILAD--ANLEKIN-K LYQ-DNk--ENIPVDE-- 1306
WP_001040104 1241 SRYNESKgKPEEiEKKQE--FVNQHVSYFDDILQLINDFSKRVILAD--ANLEKIN-K LYQ-DNk--ENISVDE-- 1306
WP_001040105 1241 SRYNESKgKPEEiEKKQE--FVNQHVSYFDDILQLINDFSKRVILAD--ANLEKIN-K LYQ-DNk--ENISVDE-- 1306
WP_001040106 1241 SRYNELKgKPEEiEQKQE--FVVQHVSYFDDILQIINDFSNRVILAD--ANLEKIN-K LYQ-DNk--ENISVDE-- 1306
WP_001040107 1241 SRYNELKgKPEEiEQKQE--FVVQHVSYFDDILQIINDFSNRVILAD--ANLEKIN-K LYQ-DNk--ENISVDE-- 1306
WP_001040108 1241 SRYNELKgKPEEiEQKQE--FVVQHVSYFDDILQIINDFSNRVILAD--ANLEKIN-K LYQ-DNk--ENISVDE-- 1306
WP_001040109 1241 SRYNELKgKPEEiEQKQE--FVVQHVSYFDDILQIINDFSNRVILAD--ANLEKIN-K LYQ-DNk--ENISVDE-- 1306
WP_001040110 1241 SRYNELKgKPEEiEQKQE--FVVQHVSYFDDILQIINDFSNRVILAD--ANLEKIN-K LYQ-DNk--ENISVDE-- 1306
WP_015058523 1241 SRYNESKgKPEEiEKKQE--FVNQHVSYFDDILQLINDFSKRVILAD--ANLEKIN-K LYS-DNk--DNTPVDE-- 1306
WP_017643650 1241 SRYNELKgKPEEiEQKQE--FVVQHVSYFDDILQIINDFSNRVILAD--ANLEKIN-K LYQ-DNk--ENIPVDE-- 1306
WP_017647151 1241 SRYNELKgKPEEiEQKQE--FVVQHVSYFDDILQIINDFSNRVILAD--ANLEKIN-K LYQ-DNk--ENISVDE-- 1306
WP_017648376 1241 SRYNELKgKPEEiEQKQE--FVVQHVSYFDDILQIINDFSNRVILAD--ANLEKIN-K LYQ-DNk--ENISVDE-- 1306
WP_017649527 1241 SRYNESKgKPEEiEKKQE--FVNQHVSYFDDILQLINDFSKRVILAD--ANLEKIN-K LYQ-DNk--ENISVDE-- 1306
WP_017771611 1241 SRYNELKgKPEEiEQKQE--FVVQHVSYFDDILQIINDFSNRVILAD--ANLEKIN-K LYQ-DNk--ENISVDE-- 1306
WP_017771984 1241 SRYNESKgKPEEiEKKQE--FVNQHVSYFDDILQLINDFSKRVILAD--ANLEKIN-K LYQ-DNk--ENISVDE-- 1306
CFQ25032     1241 SRYNESKgKPEEiEKKQE--FVNQHVSYFDDILQLINDFSKRVILAD--ANLEKIN-K LYQ-DNk--ENISVDE-- 1306
CFV16040     1241 SRYNESKgKPEEiEKKQE--FVNQHVSYFDDILQLINDFSKRVILAD--ANLEKIN-K LYQ-DNk--ENISVDE-- 1306
KLJ37842     1241 SRYNESKgKPEEiEKKQE--FVNQHVSYFDDILQLINDFSKRVILAD--ANLEKIN-K LYQ-DNk--ENISVDE-- 1306
KLJ72361     1241 SRYNESKgKPEEiEKKQE--FVNQHVSYFDDILQLINDFSKRVILAD--ANLEKIN-K LYQ-DNk--ENISVDE-- 1306
KLL20707     1255 SRYNESKgKPEEiEKKQE--FVNQHVSYFDDILQLINDFSKRVILAD--ANLEKIN-K LYQ-DNk--ENISVDE-- 1320
KLL42645     1241 SRYNELKgKPEEiEQKQE--FVVQHVSYEDDILQIINDFSNRVILAD--ANLEKIN-K LYQ-DNk--ENISVDE-- 1306
WP_047207273 1241 SRYNESKgKPEEiEKKQE--FVNQHVSYFDDILQLINDFSKRVILAD--ANLEKIN-K LYQ-DNk--ENISVDE-- 1306
WP_047209694 1241 SRYNELKgKPEEiEQKQE--FVVQHVSYFDDILQIINDFSNRVILAD--ANLEKIN-K LYQ-DNk--ENIPVDE-- 1306
WP_050198062 1241 SRYNESKgKPEEiEKKQE--FVNQHVSYFDDILQLINDFSKRVILAD--ANLEKIN-K LYQ-DNk--ENISVDE-- 1306
WP_050201642 1241 SRYNESKgKPEEiEKKQE--FVNQHVSYFDDILQLINDFSKRVILAD--ANLEKIN-K LYQ-DNk--ENISVDE-- 1306
WP_050204027 1241 SRYNELKgKPEEiEQKQE--FVVQHVSYFDDILQIINDFSNRVILAD--ANLEKIN-K LYQ-DNK--ENISVDE-- 1306
```

-continued

| | | |
|---|---|---|
| WP_050881965 | 1241 SRYNESKgKPEEiEKKQE--FVNQHVSYFDDILQLINDFSKRVILAD--ANLEKIN-K LYQ-DNk--ENISVDE-- | 1306 |
| WP_050886065 | 1241 SRYNESKgKPEEiEKKQE--FVNQHVSYFDDILQLINDFSKRVILAD--ANLEKIN-K LYQ-DNk--ENISVDE-- | 1306 |
| AHN30376 | 1241 SRYNESKgKPEEiEKKQE--FVNQHVSYFDDILQLINDESKRVILAD--ANLEKIN-K LYS-DNk--DNTPVDE-- | 1306 |
| EAO78426 | 1241 SRYNESKgKPEEiEKKQE--FVNQHVSYFDDILQLINDESKRVILAD--ANLEKIN-K LYQ-DNk--ENISVDE-- | 1306 |
| CCW42055 | 1241 SRYNESKgKPEEiEKKQE--FVNQHVSYFDDILQIINDFSNRVILAD--ANLEKIN-K LYQ-DNk--ENISVDE-- | 1306 |
| WP_003041502 | 1254 KRIN----NPIN-KDHIE--YVKKHRDDFKELLNYVLEFNEKYVGAT--KNGERLK-E AVA-DF---DSKSNEE-- | 1313 |
| WP_037593752 | 1223 YQIE----KNYE-PEHRE--YVEKHKDEFKELLEYISVFSRKYVLAD--NNLTKIE-M LFS-KN---KDAEVSS-- | 1282 |
| WP_049516684 | 1223 YRIE----KDYE-PEHRE--YVEKHKDEFKELLEYISVFSRKYVLAD--NNLTKIE-M LFS-KN---KDAEVSS-- | 1282 |
| GAD46167 | 1222 YQIE----KNYE-PEHRE--YVEKHKDEFKELLEYISVFSRKYVLAD--NNLTKIE-M LFS-KN---KDAEVSS-- | 1281 |
| WP_018363470 | 1254 HRIG----NFNS-AEHLK--YVSEHKKEFEEVLSCVENFANVYVDVE--KNLSKIR-A AAD-SM---DNFSIEE-- | 1313 |
| WP_003043819 | 1249 QNISATTgSNNLg-------YIEQHREEFKEIFEKIIDFSEKYILKN--KVNSNLK-S SFD-EQfavSDSIL--l- | 1310 |
| WP_006269658 | 1222 YRIE----KDYE-PEHRE--YVEKHKDEFKELLEYISVFSRKYVLAD--NNLTKIE-M LFS-KN---KDAEVSS-- | 1281 |
| WP_048800889 | 1242 HRID----NSDN-SEHLK--YITEHKEEFGKLLSYIENFAKSYVDVD--KNLEKIQ-L AVE-KI---DSFSVKE-- | 1301 |
| WP_012767106 | 1246 -HAHKIESSKE--LEHEA--YILDHYNDLYQLLSYIERFASLYVDVE--KNISKVK-E LFS-NI---ESYSISEi- | 1308 |
| WP_014612333 | 1246 -HAHKIESSKE--LEHEA--YILDHYNDLYQLLSYIERFASLYVDVE--KNISKVK-E LFS-NI---ESYSISEi- | 1308 |
| WP_015017095 | 1246 -HAHKIESSKE--LEHEA--YILDHYNDLYQLLSYIERFASLYVDVE--KNISKVK-E LFS-NI---ESYSISEi- | 1308 |
| WP_015057649 | 1246 -HAHKIESSKE--LEHEA--YILDHYNDLYQLLSYIERFASLYVDVE--KNISKVK-E LFS-NI---ESYSISEi- | 1308 |
| WP_048327215 | 1246 -HAHKIESSKE--LEHEA--YILDHYNDLYQLLSYIERFASLYVDVE--KNISKVK-E LFS-NI---ESYSISEi- | 1308 |
| WP_049519324 | 1246 -HAHKIESSKE--LEHEA--YILDHYNDLYQLLSYIERFASLYVDVE--KNISKVK-E LFS-NI---ESYSISEi- | 1308 |
| WP_012515931 | 1220 AHYHELTgSSEDvLRKKY--FVDRHLHYFDDIIQMINDFAERHILAS--SNLEKIN-H TYH-NN---SDLPVNEr- | 1285 |
| WP_021320964 | 1220 AHYHELTgSSEDvLRKKY--FVERHLHYFDDIIQMINDFAERHILAS--SNLEKIN-H TYH-NN---SDLPINEr- | 1285 |
| WP_037581760 | 1220 AHYHELTgSSEDvLRKKY--FVERHLHYFDDIIQMINDFAERHILAS--SNLEKIN-H TYH-NN---SDLPVNEr- | 1285 |
| WP_004232481 | 1252 QHVN----NSHK-PEHLN--YVKQHKDEFKDIFNLIISIARINILKP--KVVDNL----IN-EF---TEYGQED-- | 1308 |
| WP_009854540 | 1247 HRAD----NENS-TEYLN--YVSEHKKEFEKVLSCVEDFANLYVDVE--KNLSKIR-A VAD-SM---DNFSIEE-- | 1306 |
| WP_012962174 | 1248 HRVN----SFNN-SEHLK--YVSEHKKEFGEVLSCVENFAKSYVDVE--KNLGKIR-A VAD-KI---DTFSIED-- | 1307 |
| WP_039695303 | 1249 HRAD----NFNS-TEYLN--YVSEHKKEFEKVLSCVEDFANLYVDVE--KNLSKIR-A VAD-SM---DNFSIEE-- | 1308 |
| WP_014334983 | 1252 HRID----SFNS-TEHLK--YVSEHKKEFEKVLSCVENFSNLYVDVE--KNLSKVR-A AAE-SM---TNFSLEE-- | 1311 |
| WP_003099269 | 1240 SHYTKFTgKEEDrEKKRS--YVESHLYYFDEIMQIIVEYSNRYILAD--SNLIKIQ-N LYK-EKd---NFSIEEq- | 1305 |
| AHY15608 | 1240 SHYTKFTgKEEDrEKKRS--YVESHLYYFXEVKSSF---------------------------------------- | 1273 |
| AHY17476 | 1240 SHYTKFTgKEEDrEKKRS--YVESHLYXFX---------------------------------------------- | 1267 |
| ESR09100 | 72 SHYTKFTgKEEDrEKKRS--YVESHLYYFDEIMQIIVEYSNRYILAD--SNLIKIQ-N LYK--Ek--DNFSIEEq- | 137 |
| AGM98575 | 1240 SHYTKFTgKEEDrEKKRS--YVESHLYYFDVRLSQVFRVINVEF-------------------------------- | 1281 |
| ALF27331 | 1222 KNIH----KVDE-PKHLD--YVKKHKDEFKELLDVVSNFSKKNILAE--SNLEKIE-E LYA-QN---NNKDITE-- | 1281 |
| WP_018372492 | 1229 KKVDVLVkSKDD---DYD---LEEHRAEFAELLDCIKKENDMYILAS--SNMSKIE-E IYQ-KNi---DAPIEE-- | 1289 |
| WP_045618028 | 1252 QRIN----KISE-PIHKQ--YVETHQSEFKELLTAIISLSKKYI-QK--PNVESL--- LQQ-AF---DQSDKDIyq | 1310 |
| WP_045635197 | 1247 KNVH----KLDE-PGHLE--YIQKHRNEFKDLLNLVSEFSQKYVLAD--ANLEKIK-S LYA-DN---EQADIEI-- | 1306 |
| WP_002263549 | 1222 KNIH----KVDE-PKHLD--YVDKHKDEFKELLDVVSNFSKKYTLAE--GNLEKIK-E LYA-QN---NGEDLKE-- | 1281 |
| WP_002263887 | 1222 KNIH----KVDE-PKHLD--YVDKHKDEFKELLDVVSNFSKKYTLAE--GNLEKIK-E LYA-QN---NGEDLKE-- | 1281 |
| WP_002264920 | 1222 KNIH----KVDE-PKHLD--YVDKHKDEFKELLDVVSNFSKKYTLAE--GNLEKIK-E LYA-QN---NGEDLKE-- | 1281 |
| WP_002269043 | 1222 KNIH----KVDE-PKHLD--YVDKHKDEFKELLDVVSNFSKKYTLAE--GNLEKIK-E LYA-QN---NGEDLKE-- | 1281 |

-continued

```
WP_002269448  1222 KNIH----KVDE-PKHLD--YVDKHKDEFKELLDVVSNFSKKYTLAE--GNLEKIK-E LYA-QN---NGEDLKE--  1281

WP_002271977  1222 KNIH----KVDE-PKHLD--YVDKHKDEFKELLDVVSNFSKKYTLAE--GNLEKIK-E LYA-QN---NGEDLKE-   1281

WP_002272766  1222 KNIH----KVDE-PKHLD--YVDKHKDEFKELLDVVSNFSKKYTLAE--GNLEKIK-E LYA-QN---NGEDLKE-   1281

WP_002273241  1222 KNIH----KVDE-PKHLD--YVDKHKDEFKELLDVVSNFSKKYTLAE--GNLEKIK-E LYA-QN---NGEDLKE-   1281

WP_002275430  1222 KNIH----KVDE-PKHLD--YVDKHKDEFKELLDVVSNFSKKYTLAE--GNLEKIK-E LYA-QN---NGEDLKE--  1281

WP_002276448  1222 KNIH----KVDE-PKHLD--YVDKHKDEFKELLDVVSNFSKKYTLAE--GNLEKIK-E LYA-QN---NGEDLKE--  1281

WP_002277050  1230 HHL-------DN-DYSNE--YVKNHYQQFDILFNEITSFSKKCKLGK--EHIQKIE-E AYSKER---DSASIEE--  1287

WP_002277364  1222 KNIH----KVDE-PKHLD--YVDKHKDEFKELLDVVSNFSKKYTLAE--GNLEKIK-E LYA-QN---NGEDLKE--  1281

WP_002279025  1222 KNIH----KVDE-PKHLD--YVDKHKDEFKELLDVVSNFSKKYTLAE--GNLEKIK-E LYA-QN---NGEDLKE--  1281

WP_002279859  1222 KNIH----KVDE-PKHLD--YVDKHKDEFKELLDVVSNFSKKYTLAE--GNLEKIK-E LYA-QN---NGEDLKE--  1281

WP_002280230  1222 KNIH----KVDE-PKHLD--YVDKHKDEFKELLDVVSNFSKKYTLAE--GNLEKIK-E LYA-QN---NGEDLKE--  1281

WP_002281696  1222 KNIH----KVDE-PKHLD--YVDKHKDEFKELLDVVSNFSKKYTLAE--GNLEKIK-E LYA-QN---NGEDLKE--  1281

WP_002282247  1230 HHL-------DN-DYSNE--YVKNHYQQFDILFNEITSFSKKCKLGK--EHIQKIE-E AYSKER---DFASIEE--  1287

WP_002282906  1222 KNIH----KVDE-PKHLD--YVDKHKDEFKELLDVVSNFSKKYTLAE--GNLEKIK-E LYA-QN---NGEDLKE--  1281

WP_002283846  1222 KNIH----KVDE-PKHLD--YVDKHKDEFKELLDVVSNFSKKYTLAE--GNLEKIK-E LYA-QN---NGEDLKE--  1281

WP_002287255  1222 KNIH----KVDE-PKHLD--YVDKHKDEFKELLDVVSNFSKKYTLAE--GNLEKIK-E LYA-QN---NGEDLKE--  1281

WP_002288990  1222 KNIH----KVDE-PKHLD--YVDKHKDEFKELLDVVSNFSKKYTLAE--GNLEKIK-E LYA-QN---NGEDLKE--  1281

WP_002289641  1222 KNIH----KVDE-PKHLD--YVDKHKDEFKELLDVVSNFSKKYTLAE--GNLEKIK-E LYA-QN---NGEDLKE--  1281

WP_002290427  1222 KNIH----KVDE-PKHLD--YVDKHKDEFKELLDVVSNFSKKYTLAE--GNLEKIK-E LYA-QN---NGEDLKE--  1281

WP_002295753  1222 KNIH----KVDE-PKHLD--YVDKHKDEFKELLDVVSNFSKKYTLAE--GNLEKIK-E LYA-QN---NGEDLKE--  1281

WP_002296423  1222 KNIH----KVDE-PKHLD--YVDKHKDEFKELLDVVSNFSKKYTLAE--GNLEKIK-E LYA-QN---NGEDLKE--  1281

WP_002304487  1236 KNIH----KVDE-PKHLD--YVDKHKDEFKELLDVVSNFSKKYTLAE--GNLEKIK-E LYA-QN---NGEDLKE--  1295

WP_002305844  1222 KNIH----KVDE-PKHLD--YVDKHKDEFKELLDVVSNFSKKYTLAE--GNLEKIK-E LYA-QN---NGEDLKE--  1281

WP_002307203  1222 KNIH----KVDE-PKHLD--YVDKHKDEFKELLDVVSNFSKKYTLAE--GNLEKIK-E LYA-QN---NGEDLKE--  1281

WP_002310390  1222 KNIH----KVDE-PKHLD--YVDKHKDEFKELLDVVSNFSKKYTLAE--GNLEKIK-E LYA-QN---NGEDLKE--  1281

WP_002352408  1222 KNIH----KVDE-PKHLD--YVDKHKDEFKELLDVVSNFSKKYTLAE--GNLEKIK-E LYA-QN---NGEDLKE--  1281

WP_012997688  1222 KNIH----KVDE-PKHLD--YVDKHKDEFKELLDVVSNFSKKYTLAE--GNLEKIK-E LYA-QN---NGEDLKE--  1281

WP_014677909  1222 KNIH----KVDE-PKHLD--YVDKHKDEFKELLDVVSNFSKKYTLAE--GNLEKIK-E LYA-QN---NGEDLKE--  1281

WP_019312892  1222 KNIH----KVDE-PKHLD--YVDKHKDEFKELLDVVSNFSKKYTLAE--GNLEKIK-E LYA-QN---NGEDLKE--  1281

WP_019313659  1222 KNIH----KVDE-PKHLD--YVDKHKDEFKELLDVVSNFSKKYTLAE--GNLEKIK-E LYA-QN---NGEDLKE--  1281

WP_019314093  1222 KNIH----KVDE-PKHLD--YVDKHKDEFKELLDVVSNFSKKYTLAE--GNLEKIK-E LYA-QN---NGEDLKE--  1281

WP_019315370  1222 KNIH----KVDE-PKHLD--YVDKHKDEFKELLDVVSNFSKKYTLAE--GNLEKIK-E LYA-QN---NGEDLKE--  1281

WP_019803776  1222 KNIH----KVDE-PKHLD--YVDKHKDEFKELLDVVSNFSKKYTLAE--GNLEKIK-E LYA-QN---NGEDLKE--  1281

WP_019805234  1222 KNIH----KVDE-PKHLD--YVDKHKDEFKELLDVVSNFSKKYTLAE--GNLEKIK-E LYA-QN---NGEDLKE--  1281

WP_024783594  1222 KNIH----KVDE-PKHLD--YVDKHKDEFKELLDVVSNFSKKYTLAE--GNLEKIK-E LYA-QN---NGEDLKE--  1281

WP_024784288  1230 HHL-------DN-DYSNE--YVKNHYQQFDILFNEITSFSKKCKLGK--EHIQKIE-E AYSKER---DFASIEE--  1287

WP_024784666  1222 KNIH----KVDE-PKHLD--YVDKHKDEFKELLDVVSNFSKKYTLAE--GNLEKIK-E LYA-QN---NGEDLKE--  1281

WP_024784894  1222 KNIH----KVDE-PKHLD--YVDKHKDEFKELLDVVSNFSKKYTLAE--GNLEKIK-E LYA-QN---NGEDLKE--  1281

WP_024786433  1230 HHL-------DN-DYSNE--YVKNHYQQFDILFNEITSFSKKCKLGK--EHIQKIE-E AYSKER---DSASIEE--  1287

WP_049473442  1222 KNIH----KVDE-PKHLD--YVDKHKDEFKELLDVVSNFSKKYTLAE--GNLEKIK-E LYA-QN---NGEDLKE--  1281

WP_049474547  1222 KNIH----KVDE-PKHLD--YVDKHKDEFKELLDVVSNFSKKYTLAE--GNLEKIK-E LYA-QN---NGEDLKE--  1281
```

```
EMC03581         1215 KNIH----KVDE-PKHLD--YVDKHKDEFKELLDVVSNFSKKYTLAE--GNLEKIK-E LYA-QN---NGEDLKE--  1274

WP_000428612     1250 KNIH----RLDE-PEHLE--YIQKHRNEFKGLLNLVSEFSQKYVLAD--ANLEKIK-N LYA-DN---EQADIEI--  1309

WP_000428613     1248 KNVH----KLDE-PEHLE--YIQKHRNEFKDLLNLVSEFSQKYVLAD--ANLEKIQ-N LYA-DN---EQADIEI--  1307

WP_049523028     1243 KRIQ----KKDE-PEHLE--YIKQHHSEFNDLLNFVSEFSQKYVLAE--SNLEKIK-N LYI-DN---EQTNMEE--  1302

WP_003107102     1209 SRYTSFSgKEEDrEKHRH--FVESHLHYFDEIKDIIADFSRRYILAD--ANLEKIL-T LYN-EKn---QFSIEEq-  1274

WP_054279288     1242 SKRDK--gTQSEnME-----YISNHKEKFIEIFHYIIRYAEKNVIKP--KVIERLN-D TFNqKF---NDSDLTEl-  1303

WP_049531101     1252 QRIN----KISE-PIHKQ--YVETHQSEFEELLTTIISLSKKYI-QK--PIVESL--- LQQ-AF---EQADKDIyq  1310

WP_049538452     1252 QRIN----KISE-PIHKQ--YVEAHQNEFKELLTTIISLSKKYI-QK--PNVESL--- LQQ-AF---EQADKDIyq  1310

WP_049549711     1254 QRIN----KFSE-PIHKQ--YVEAHQNEFKELLTIIISLSKKYI-QK--PNVESL--- LHQ-AF---EQADNDIyq  1312

WP_007896501     1246 SRYDKLSsKIESeQQKKL--FVEQHLHYFDEILDIVVKHATCYIKAE--NNLKKII-S LYK-KK---EAYSINEq-  1311

EFR44625         1198 SRYDKLSsKIESeQQKKL--FVEQHLHYFDEILDIVVKHATCYIKAE--NNLKKII-S LYK-KK---EAYSINEq-  1263

WP_002897477     1247 KNLH----KLDE-PEHLE--YIQKHRNEFKDLLNLVSEFSQKYILAE--ANLEKIK-D LYA-DN---EQADIEI--  1306

WP_002906454     1253 QRIN----KISE-PIHKQ--YVEAHQNEFKELLTTIISLSKKYI-QK--PNVELL--- LQQ-AF---DQADKDIyq  1311

WP_009729476     1248 KNVH----KLDE-PGHLE--YIQKHRNEFKDLLNLVSEFSQKYVLAD--ANLEKIK-N LYA-DN---EQADIEI--  1307

CQR24647         1238 QHAN----KEDS----VI--YLEKHRHELSELFHHIIGVSEKTILKP--KVEMTLN-E AFE-KHf---EFDEVSE--  1295

WP_000066813     1252 KNVH----KLDE-PEHLE--YIQKHRYEFKDLLNLVSEFSQKYVLAD--ANLEKIK-N LYA-DN---EQADIEI--  1311

WP_009754323     1248 KNVH----KLDE-PEHLE--YIQKHRYEFKDLLNLVSEFSQKYVLAE--ANLEKIK-S LYV-DN---EQADIEI--  1307

WP_044674937     1241 SNIH----KITE-PIHLN--YVNKNKHEFKELLRHISDFSTRYILAQ--DRLSKIE-E LYD-KN---DGDDISD--  1300

WP_044676715     1243 SNIH----KITE-PIHLN--YVNKNKHEFKELLRHISDFSTRYILAQ--DRLSKIE-E LYD-KN---DGDDISD--  1302

WP_044680361     1243 SNIH----KITE-PIHLN--YVNKNKHEFKELLRHISDFSTRYILAQ--DRLSKIE-E LYD-KN---DGDDISD--  1302

WP_044681799     1241 SNIH----KITE-PIHLN--YVNKNKHEFKELLRHISDFSTRYILAQ--DRLSKIE-E LYD-KN---DGDDISD--  1300

WP_049533112     1254 KRIN----NPIN-KDHIE--YVKKHRDDFKELLNYVLEFNEKYVGAT--KNGERLK-E AVA-DF---DSKSNEE--  1313

WP_029090905     1182 STKQA-----DE-AMFLKyyRLEHLEAVFEEL---IRKQAADYQIFE--KLIKKIEvN FYS----c----TYNEk-  1240

WP_006506696     1212 YNAIYKQ-DYDNlDDILMi----------QLYIELINKMKVLPAY-rGIAEKFE-S YVV----i----SKEEk-  1268

AIT42264         1240 SHYEKLKgSPEDnEQKQL--FVEQHKHYLDEIIEQISEFSKRVILAD--ANLDKVL-S AYN-KH---RDKPIREq-  1305

WP_034440723     1218 KHYNE-----DE--TSHK--FIVEHKAYFDELLNYIVEFANKYLELE--NSIEKIK-D LYH-----gKGPDVEEke  1276

AKQ21048         1240 SHYEKLKgSPEDnEQKQL--FVEQHKHYLDEIIEQISEFSKRVILAD--ANLDKVL-S AYN-KH---RDKPIREq-  1305

WP_004636532     1212 NRYDKVK-----fPDSIE--YVHDNLAKFDDLLEYVIDFSNKYINAD--KNVQKIQ-K IYK-EH---GTEDVEL--  1271

WP_002364836     1218 KQCLL----PNQ-SESLA--YVEQHQPEFQEILERVVDFAEVHTLAK--SKVQQIV-K LFE-AN---QTADVKE--  1277

WP_016631044     1169 KQCLL----PNQ-SESLA--YVEQHQPEFQEILERVVDFAEVHTLAK--SKVQQIV-K LFE-AN---QTADVKE--  1228

EMS75795          954 QHYDEIAhKESF-----D--YVNDHLSEFREILDQVIDFSNRYTIAA--KNTEKIA-E LFE-QN---QESTVQS--  1013

WP_002373311     1218 KQCLL----PNQ-SESLA--YVEQHQPEFQEILERVVDFAEVHTLAK--SKVQQIV-K LFE-AN---QTADVKE--  1277

WP_002378009     1218 KQCLL----PNQ-SESLA--YVEQHQPEFQEILERVVDFAEVHTLAK--SKVQQIV-K LFE-AN---QTADVKE--  1277

WP_002407324     1218 KQCLL----PNQ-SESLA--YVEQHQPEFQEILERVVDFAEVHTLAK--SKVQQIV-K LFE-AN---QTADVKE--  1277

WP_002413717     1218 KQCLL----PNQ-SESLA--YVEQHQPEFQEILERVVDFAEVHTLAK--SKVQQIV-K LFE-AN---QTADVKE--  1277

WP_010775580     1220 KQCLL----PNQ-SESLA--YVEQHQPEFQEILERVVDFAEVHTLAK--SKVQQIV-K LFE-AN---QTADVKE--  1279

WP_010818269     1218 KQCLL----PNQ-SESLA--YVEQHQPEFQEILERVVDFAEVHTLAK--SKVQQIV-K LFE-AN---QTADVKE--  1277

WP_010824395     1218 KQCLL----PNQ-SESLA--YVEQHQPEFQEILERVVDFAEVHTLAK--SKVQQIV-K LFE-AN---QTADVKE--  1277

WP_016622645     1218 KQCLL----PNQ-SESLA--YVEQHQPEFQEILERVVDFAEVHTLAK--SKVQQIV-K LFE-AN---QTADVKE--  1277

WP_033624816     1218 KQCLL----PNQ-SESLA--YVEQHQPEFQEILERVVDFAEVHTLAK--SKVQQIV-K LFE-AN- -QTADVKE--  1277
```

-continued

```
WP_033625576   1218 KQCLL----PNQ-SESLA--YVEQHQPEFQEILERVVDFAEVHTLAK--SKVQQIV-K LFE-TN---QTADVKE--   1277
WP_033789179   1218 KQCLL----PNQ-SESLA--YVEQHQPEFQEILERVVDFAEVHTLAK--SKVQQIV-K LFE-AN---QTADVKE--   1277
WP_002310644   1220 KQYDEIShKESF-----D--YVNEHHKEFSEVFARVLEFAGKYTLAE--KNIEKLE-K IYK-EN---QTDDLAK--   1279
WP_002312694   1221 KQYDEIShKESF-----D--YVNEHHKEFSEVFARVLEFAGKYTLAE--KNIEKLE-K IYK-EN---QTDDLAK--   1280
WP_002314015   1221 KQYDEIShKESF-----D--YVNEHHKEFSEVFARVLEFAGKYTLAE--KNIEKLE-K IYK-EN---QTDDLAK--   1280
WP_002320716   1221 KQYDEIShKESF-----D--YVNEHHKEFSEVFARVLEFAGKYTLAE--KNIEKLE-K IYK-EN---QTDDLAK--   1280
WP_002330729   1220 KQYDEIShKESF-----D--YVNEHHKEFSEVFARVLEFAGKYTLAE--KNIEKLE-K IYK-EN---QTDDLAK--   1279
WP_002335161   1221 KQYDEIShKESF-----D--YVNEHHKEFSEVFARVLEFAGKYTLAE--KNIEKLE-K IYK-EN---QTDDLAK--   1280
WP_002345439   1221 KQYDEIShKESF-----D--YVNEHHKEFSEVFARVLEFAGKYTLAE--KNIEKLE-K IYK-EN---QTDDLAK--   1280
WP_034867970   1211 QHYDKITyQESF-----D--YVNTHLSDFSAILTEVLAFAEKYTLAD--KNIERIQ-E LYE-EN---KYGETSM--   1270
WP_047937432   1221 KQYDEIShKESF-----D--YVNEHHKEFSEVFARVLEFAGKYTLAE--KNIEKLE-K IYK-EN---QTDDLAK--   1280
WP_010720994   1211 QHYDKITyQESF-----D--YVNTHLSDFSAILTEVLAFAEKYTLAD--KNIERIQ-E LYE-EN---KYGEISM--   1270
WP_010737004   1211 QHYDKITyQESF-----D--YVNTHLSDFSAILTEVLAFAEKYTLAD--KNIERIQ-E LYE-EN---KYGETSM--   1270
WP_034700478   1211 QHYDKITyQESF-----D--YVNTHLSDFSAILTEVLAFAEKYTLAD--KNIERIQ-E LYE-EN---KYGEISM--   1270
WP_007209003   1209 KKIIN--gKNSD---SVS--YIQNNKEKFREIFEYIVDFSSKYISAD--ANLNKIE-K IFE-NNfh----KASEqe   1269
WP_023519017   1205 RHYDEINhKVSF-----D--YVNAHKEGENDIFDFISDFGVRYILAP--QHLEKIK-V AYE-KN---KEVDLKE--   1264
WP_010770040   1216 KQVDE-----DS-GKSEE--YVREHRAEFAEILNYVQAFSETKILAN--KNLQTIL-K LYE-EN---KEADIKE--   1274
WP_048604708   1213 KHCNE-----KP-D-SLK--YVTEHQSGFSEIMAHVKDFAEKYTLVD--KNLEKIL-S LYA-KN---MDSEVKE--   1270
WP_010750235   1214 NHYDEIAyKDSY-----D--YVNEHFSNFQDILDKVIIFAEKYTSAP--QKLNQII-A TYE-KN---QEADRKI--   1273
AII16583       1279 SHYEKLKgSPEDnEQKQL--FVEQHKHYLDEIIEQISEFSKRVILAD--ANLDKVL-S AYN-KH---RDKPIREq-   1344
WP_029073316   1226 YKAMKYK-NYSElSQEEIm-----------NVYDIFVEKLKLYYPTY-KNIATNFE-N FEN----i----SDEEk-   1282
WP_031589969   1226 YKAMKYK-NYDNlDSEKIi-----------DLYRLLINKMELYYPEYrkQLVKKFE-D LKV----i----SIEEk-   1283
KDA45870       1200 NAKDG--------EQKLE-----DHKAEFKELFDKIMEFADKYVVAP--KNSEKIR-R LYE-ENq-----DATPme   1253
WP_039099354   1242 LPLTQ-----SEeLAEQV----------YDEILDQVMHYFPLYDTNQfrAKLSAGKaA DGN-KMV-----QVGQqv   1306
AKP02966       1238 QIPDE------DpDQILAf----YDKNILVEILQELITKMKKFYPFY--KNEQEFLaS FNQ--------ATTSEk-   1296
WP_010991369   1216 ANCEV-----SD-GKSLD--YIESNREMFAELLAHVSEFAKRYTLAE--ANLNKIN-Q LFE-QN---KEGDIKA--   1274
WP_033838504   1216 ANCEV-----SD-GKSLD--YIESNREMFAELLAHVSEFAKRYTLAE--ANLNKIN-Q LFE-QN---KEGDIKA--   1274
EHN60060       1219 ANCEV-----SD-GKSLD--YIESNREMFAELLAHVSEFAKRYTLAE--ANLNKIN-Q LFE-QN---KEGDIKA--   1277
EFR89594        985 ANCEV-----SD-GKSLD--YIESNREMFAELLAHVSEFAKRYTLAE--ANLNKIN-Q LFE-QN---KEGDIKA--   1043
WP_038409211   1216 KNCEA-----ND-GESLA--YIEMHREMFAELLAYISEFAKRYTLAN--DRLEKIN-M FFE-QN---KKGDIKV--   1274
EFR95520        835 KNCEA-----ND-GESLA--YIEMHREMFAELLAYISEFAKRYTLAN--DRLEKIN-M FFE-QN---KKGDIKV--    893
WP_003723650   1216 KNCEA-----SD-GKSLK--YIEAHRETFSELLAQVSEFATRYTLAD--ANLSKIN-N LFE-QN---KEGDIKA--   1274
WP_003727705   1216 KNCEA-----SD-GKSLK--YIEAHRETFSELLAQVSEFATKYTLAD--ANLSKIN-N LFE-QN---KEGDIKA--   1274
WP_003730785   1216 KNCEA-----SD-GKSLK--YIEAHRETFSELLAQVSEFATKYTLAD--ANLSKIN-N LFE-QN---KEGDIKA--   1274
WP_003733029   1216 EKYEA-----ID-GESLA--YIEVHRALFDELLAYISEFARKYTLSN--DRLDEIN-M LYE-RN---KDGDVKS--   1274
WP_003739838   1216 KNCEA-----SD-GKSLD--YIESNREMFGELLAHVSEFAKRYTLAD--ANLSKIN-Q LFE-QN---KDNDIKV--   1274
WP_014601172   1216 KNCEA-----SD-GKSLK--YIEAHRETFSELLAQVSEFATRYTLAD--ANLSKIN-N LFE-QN---KEGDIQA--   1274
WP_023548323   1216 EKREA-----ID-GESLA--YIEAHKAVFGELLAHISEFARKYTLAN--DKLDEIN-M LYE-RN---KDGDVKS--   1274
WP_031665337   1216 KNCEA-----SD-GKSLK--YIEAHRETFSELLAQVSEFATRYTLAD--ANLSKIN-N LFE-QN---KEGDIKA--   1274
WP_031669209   1216 EKYEA-----ID-GESLA--YIEVHRALFDELLAYISEFARKYTLSN--DRLDEIN-M LYE-RN---KDGDVKS--   1274
WP_033920898   1216 EKREA-----ID-GESLA--YIEAHKAVFGELLAHISEFARKYTLAN--DKLDEIN-M LYE-RN---KDGDVKS--   1274
```

```
AKI42028          1219 KNCEA-----SD-GKSLK--YIEAHRETFSELLAQVSEFATRYTLAD--ANLSKIN-N LFE-QN---KEGDIQA--  1277
AKI50529          1219 EKREA-----ID-GESLA--YIEAHKAVFGELLAHISEFARKYTLAN--DKLDEIN-M LYE-RN---KDGDVKS--  1277
EFR83390           664 KNCEA-----SD-GKSLK--YTEAHRETFSELLAQVSEFATRYTLAD--ANLSKIN-N LFE-QN---KEGDIKX--   722
WP_046323366      1216 KNCEA-----SD-GKSLA--YIESHREMFAELLDSISEFASRYTLAD--ANLEKIN-T IFE-QN---KSGDVKV--  1274
AKE81011          1256 SHYEKLKgSPEDnEQKQL--FVEQHKHYLDEIIEQISEFSKRVILAD--ANLDKVL-S AYN-KH---RDKPIREq-  1321
CUO82355          1216 YNAIYKQ-DFDGlDNMLMi----------QLYLQLIDKLKTLYPIY-mGIVEKFE-K FVS----i----SKEEk-  1272
WP_033162887      1218 YAAMLKK-RYEYIDEEEIf----------DLYLQLLQKMDTLYPAY-kGIAKRFF-D FKN----i----DVVEk-  1274
AGZ01981          1273 SHYEKLKgSPEDnEQKQL--FVEQHKHYLDEIIEQISEFSKRVILAD--ANLDKVL-S AYN-KH---RDKPIREq-  1338
AKA60242          1240 SHYEKLKgSPEDnEQKQL--FVEQHKHYLDEIIEQISEFSKRVILAD--ANLDKVL-S AYN-KH---RDKPIREq-  1305
AKS40380          1240 SHYEKLKgSPEDnEQKQL--FVEQHKHYLDEIIEQISEFSKRVILAD--ANLDKVL-S AYN-KH---RDKPIREq-  1305
4UN5_B            1244 SHYEKLKgSPEDnEQKQL--FVEQHKHYLDEIIEQISEFSKRVILAD--ANLDKVL-S AYN-KH---RDKPIREq-  1309
WP_010922251      1306 -AE---NII HLFTLTNLGAP-AAFKYFD--TTI---DRK--R-YTSTKEVL DATLIHQSITGLYETRIDLSQL--  1365
WP_039695303      1309 ISN---SFI NLLTLTALGAP-ADFNFLG--EKI---PRK--R-YTSTKECL NATLIHQSITGLYETRIDLSKL--  1369
WP_045635197      1307 LAN---SFI NLLTFTALGAP-AAFKFFG--KDI---DRK--R-YTTVSEIL NATLIHQSITGLYETWIDLSKL--  1367
5AXW_A                 --------- ---------------------------------------- ------------------------
WP_009880683       990 -AE---NII HLFTLTNLGAP-AAFKCFD--TTI---GRN--R-YKSIKEVL DATLIHQSITGLYETRIDLSQL--  1049
WP_010922251      1306 -AE---NII HLFTLTNLGAP-AAFKYFD--TTI---DRK--R-YTSTKEVL DATLIHQSITGLYETRIDLSQL--  1365
WP_011054416      1306 -AE---NII HLFTLTNLGAP-AAFKYFD--TTI---DRK--R-YTSTKEVL DATLIHQSITGLYETRIDLSQL--  1365
WP_011284745      1306 -AE---NII HLFTLTNLGAP-AAFKYFD--TTI---DRK--R-YTSTKEVL DATFIHQSITGLYETRIDLSQL--  1365
WP_011285506      1306 -AE---NII HLFTLTNLGAP-AAFKYFD--TTI---DRK--R-YTSTKEVL DATLIHQSITGLYETRIDLSQL--  1365
WP_011527619      1306 -AE---NII HLFTLTNLGAP-TAFKYFD--TTI---DRK--R-YTSTKEVL DATFIHQSITGLYETRIDLSQL--  1365
WP_012560673      1306 -AE---NII HLFTLTNLGAP-AAFKCFD--TTI---GRN--R-YKSIKEVL DATLIHQSITGLYETRIDLSQL--  1365
WP_014407541      1305 -AE---NII HLFTLTNLGAP-AAFKYFD--TTI---DRK--R-YTSTKEVL DATLIHQSITGLYETRIDLSQL--  1364
WP_020905136      1306 -AE---NII HLFTLTNLGAP-AAFKYFD--TTI---DRK--R-YTSTKEVL DATLIHQSITGLYETRIDLSQL--  1365
WP_023080005      1305 -AK---NII HLFTLTNLGAP-AAFKYFD--TTI---ERN--R-YKSIKEVL DATLIHQSITGLYETRIDLSQL--  1364
WP_023610282      1305 -AK---NII HLFTLTNLGAP-AAFKYFD--TTI---ERN--R-YKSIKEVL DATLIHQSITGLYEIRIDLSQL--  1364
WP_030125963      1306 -AE---NII HLFTLTNLGAP-AAFKYFD--TTI---GRN--R-YKSIKEVL DATLIHQSITGLYETRIDLSQL--  1365
WP_030126706      1306 -AE---NII HLFTLTNLGAP-AAFKYFD--TTI---DRK--R-YTSTKEVL DATLIHQSITGLYETRIDLSQL--  1365
WP_031488318      1306 -AE---NII HLFTLTNFGAP-AAFIYFD--TTI---GRN--R-YKSIKEVL DATLIHQSITGLYETRIDLSQL--  1365
WP_032460140      1306 -AE---NII HLFTLTNLGAP-AAFKYFD--TTI---GRN--R-YKSIKEVL DATLIHQSITGLYETRIDLSQL--  1365
WP_032461047      1306 -AE---NII HLFTLTNLGAP-AAFKYFD--TTI---GRN--R-YKSIKEVL DATLIHQSITGLYETRIDLSQL--  1365
WP_032462016      1306 -AE---NII HLFTLTNLGAP-AAFKYFD--TTI---DRK--R-YTSTKEVL DATLIHQSITGLYETRIDLSQL--  1365
WP_032462936      1306 -AE---NII HLFTLTNLGAP-AAFKYFD--TTI---DRK--R-YTSTKEVL DATLIHQSITGLYETRIDLSQL--  1365
WP_032464890      1306 -AE---NII HLFTLTNLGAP-TAFKYFD--TTI---DRK--R-YTSTKEVL DATFIHQSITGLYETRIDLSQL--  1365
WP_033888930      1131 -AE---NII HLFTLTNLGAP-AAFKYFD--TTI---DRK--R-YTSTKEVL DATLIHQSITGLYETRIDLSQL--  1190
WP_038431314      1306 -AE---NII HLFTLTNLGAP-AAFKYFD--TTI---DRK--R-YTSTKEVL DATLIHQSITGLYETRIDLSQL--  1365
WP_038432938      1305 -AK---NII HLFTLTNLGAP-AAFKYFD--TTI---ERN--R-YKSIKEVL DATLIHQSITGLYETRIDLSQL--  1364
WP_038434062      1306 -AE---NII HLFTLTNLGAP-AAFKYFD--TTI---GRN--R-YKSIKEVL DATLIHQSITGLYETRIDLSQL--  1365
BAQ51233          1217 -AE---NII HLFTLTNLGAP-AAFKYFD--TTI---DRK--R-YTSTKEVL DATLIHQSITGLYETRIDLSQL--  1276
KGE60162           481 -AE---NII HLFTLTNLGAP-AAFKYFD--TTI---DRK--R-YTSTKEVL DATLIHQSITGLYETRIDLSQL--   540
```

```
KGE60856          244 -AE---NII HLFTLTNLGAP-AAFKYFD--TTI--DRK--R-YTSTKEVL DATLIHQSITGLYETRIDLSQL--  303
WP_002989955     1306 -AE---NII HLFTLTNLGAP-TAFKYFD--TTI--DRK--R-YTSTKEVL DATFIHQSITGLYETRIDLSQL-- 1365
WP_003030002     1282 LAK---SFI SLLTFTAFGAP-AAFNFFG--ENI--DRK--R-YTSVTECL NATLIHQSITGLYETRIDLSKL-- 1342
WP_003065552     1310 ISN---SFI NLLTLTALGAP-ADFNFLG--EKI--PRK--R-YTSTKECL NATLIHQSITGLYETRIDLSKI-- 1370
WP_001040076     1307 LAN---NII NLFTFTSLGAP-AAFKFFD--KIV--DRK--R-YTSTKEVL NSTLIHQSITGLYETRIDLGKL-- 1367
WP_001040078     1315 LAN---NII NLFTFTSLGAP-AAFKFFD--KIV--DRK--R-YTSTKEVL NSTLIHQSITGLYETRIDLSKL-- 1375
WP_001040080     1307 LAN---NII NLFTFTSLGAP-AAFKFFD--KIV--DRK--R-YTSTKEVL NSTLIHQSITGLYETRIDLGKL-- 1367
WP_001040081     1307 LAN---NII NLFTFTSLGAP-AAFKFFD--KIV--DRK--R-YTSTKEVL NSTLIHQSITGLYETRIDLGKL-- 1367
WP_001040083     1307 LAN---NII NLFTFTSLGAP-AAFKFFD--KIV--DRK--R-YTSTKEVL NSTLIHQSITGLYETRIDLGKL-- 1367
WP_001040085     1307 LAN---NII NLFTFTSLGAP-AAFKFFD--KIV--DRK--R-YTSTKEVL NSTLIHQSITGLYETRIDLGKL-- 1367
WP_001040087     1307 LAN---NII NLFTFTSLGAP-AAFKFFD--KIV--DRK--R-YTSTKEVL NSTLIHQSITGLYETRIDLGKL-- 1367
WP_001040088     1307 LAN---NII NLFTFTSLGAP-AAFKFFD--KIV--DRK--R-YTSTKEVL NSTLIHQSITGLYETRIDLGKL-- 1367
WP_001040089     1307 LAN---NII NLFTFTSLGAP-AAFKFFD--KIV--DRK--R-YTSTKEVL NSTLIHQSITGLYETRIDLGKL-- 1367
WP_001040090     1307 LAN---NII NLFTFTSLGAP-AAFKFFD--KIV--DRK--R-YTSTKEVL NSTLIHQSITGLYETRIDLGKL-- 1367
WP_001040091     1307 LAN---NII NLFTFTSLGAP-AAFKFFD--KIV--DRK--R-YTSTKEVL NSTLIHQSITGLYETRIDLGKL-- 1367
WP_001040092     1307 LAK---NII NLFTFTSLGAP-AAFKFFD--KSV--DRK--R-YTSTKEVL DSTLIHQSITGLYETRIDLGKL-- 1367
WP_001040094     1307 LAN---NII NLFTFTSLGAP-AAFKFFD--KIV--DRK--R-YTSTKEVL NSTLIHQSITGLYETRIDLGKL-- 1367
WP_001040095     1307 LAN---NII NLFTFTSLGAP-AAFKFFD--KIV--DRK--R-YTSTKEVL NSTLIHQSITGLYETRIDLGKL-- 1367
WP_001040096     1307 LAN---NII NLFTFTSLGAP-AAFKFFD--KIV--DRK--R-YTSTKEVL NSTLIHQSITGLYETRIDLGKL-- 1367
WP_001040097     1307 LAN---NII NLFTFTSLGAP-AAFKFFD--KIV--DRK--R-YTSTKEVL NSTLIHQSITGLYETRIDLGKL-- 1367
WP_001040098     1307 LAN---NII NLFTFTSLGAP-AAFKFFD--KIV--DRK--R-YTSTKEVL NSTLIHQSITGLYETRIDLGKL-- 1367
WP_001040099     1307 LAN---NII NLFTFTSLGAP-AAFKFFD--KIV--DRK--R-YTSTKEVL NSTLIHKSITGLYETRIDLGKL-- 1367
WP_001040100     1307 LAN---NII NLFTFTSLGAP-AAFKFFD--KIV--DRK--R-YTSTKEVL NSTLIHQSITGLYETRIDLGKL-- 1367
WP_001040104     1307 LAN---NII NLFTFTSLGAP-AAFKFFD--KIV--DRK--R-YTSTKEVL NSTLIHQSITGLYETRIDLGKL-- 1367
WP_001040105     1307 LAN---NII NLFTFTSLGAP-AAFKFFD--KIV--DRK--R-YTSTKEVL NSTLIHQSITGLYETRIDLGKL-- 1367
WP_001040106     1307 LAN---NII NLFTFTSLGAP-AAFKFFD--KIV--DRK--R-YTSTKEVL NSTLIHQSITGLYETRIDLGKL-- 1367
WP_001040107     1307 LAN---NII NLFTFTSLGAP-AAFKFFD--KIV--DRK--R-YTSTKEVL NSTLIHQSITGLYETRIDLGKL-- 1367
WP_001040108     1307 LAN---NII NLFTFTSLGAP-AAFKFFD--KIV--DRK--R-YTSTKEVL NSTLIHQSITGLYETRIDLGKL-- 1367
WP_001040109     1307 LAN---NII NLFTFTSLGAP-AAFKFFD--KIV--DRK--R-YTSTKEVL NSTLIHQFITGLYETRIDLGKL-- 1367
WP_001040110     1307 LAN---NII NLFTFTSLGAP-AAFKFFD--KIV--DRK--R-YTSTKEVL NSTLIHQSITGLYETRIDLGKL-- 1367
WP_015058523     1307 LAK---NII NLFTFTSLGAP-AAFKFFD--KSV--DRK--R-YTSTKEVL DSTLIHQSITGLYETRIDLGKL-- 1367
WP_017643650     1307 LAN---NII NLFTFTSLGAP-AAFKFFD--KIV--DRK--R-YTSTKEVL NSTLIHQSITGLYETRIDLGKL-- 1367
WP_017647151     1307 LAN---NII NLFTFTSLGAP-AAFKFFD--KIV--DRK--R-YTSTKEVL NSTLIHQSITGLYETRIDLGKL-- 1367
WP_017648376     1307 LAN---NII NLFTFTSLGAP-AAFKFFD--KIV--DRK--R-YTSTKEVL NSTLIHQSITGLYETRIDLGKL-- 1367
WP_017649527     1307 LAN---NII NLFTFTSLGAP-AAFKFFD--KIV--DRK--R-YTSTKEVL NSTLIHQSITGLYETRIDLGKL-- 1367
WP_017771611     1307 LAN---NII NLFTFTSLGAP-AAFKFFD--KIV--DRK--R-YTSTKEVL NSTLIHQSITGLYETRIDLGKL-- 1367
WP_017771984     1307 LAN---NII NLFTFTSLGAP-AAFKFFD--KIV--DRK--R-YTSTKEVL NSTLIHQSITGLYETRIDLGKL-- 1367
CFQ25032         1307 LAN---NII NLFTFTSLGAP-AAFKFFD--KIV--DRK--R-YTSTKEVL NSTLIHQSITGLYETRIDLGKL-- 1367
CFV16040         1307 LAN---NII NLFTFTSLGAP-AAFKFFD--KIV--DRK--R-YTSTKEVL NSTLIHQSITGLYETRIDLGKL-- 1367
KLJ37842         1307 LAN---NII NLFTFTSLGAP-AAFKFFD--KIV--DRK--R-YTSTKEVL NSTLIHQSITGLYETRIDLGKL-- 1367
```

-continued

| | | | |
|---|---|---|---|
| KLJ72361 | 1307 LAN---NII NLFTFTSLGAP-AAFKFFD--KIV--DRK--R-YTSTKEVL | NSTLIHQSITGLYETRIDLGKL-- | 1367 |
| KLL20707 | 1321 LAN---NII NLFTFTSLGAP-AAFKFFD--KIV--DRK--R-YTSTKEVL | NSTLIHQSITGLYETRIDLGKL-- | 1381 |
| KLL42645 | 1307 LAN---NII NLFTFTSLGAP-AAFKFFD--KIV--DRK--R-YTSTKEVL | NSTLIHQSITGLYETRIDLGKL-- | 1367 |
| WP_047207273 | 1307 LAN---NII NLFTFTSLGAP-AAFKFFD--KIV--DRK--R-YTSTKEVL | NSTLIHQSITGLYETRIDLGKL-- | 1367 |
| WP_047209694 | 1307 LAN---NII NLFTFTSLGAP-AAFKFFD--KIV--DRK--R-YTSTKEVL | NSTLIHKSITGLYETRIDLGKL-- | 1367 |
| WP_050198062 | 1307 LAN---NII NLFTFTSLGAP-AAFKFFD--KIV--DRK--R-YTSTKEVL | NSTLIHQSITGLYETRIDLGKL-- | 1367 |
| WP_050201642 | 1307 LAN---NII NLFTFTSLGAP-AAFKFFD--KIV--DRK--R-YTSTKEVL | NSTLIHQSITGLYETRIDLGKL-- | 1367 |
| WP_050204027 | 1307 LAN---NII NLFTFTSLGAP-AAFKFFD--KIV--DRK--R-YTSTKEVL | NSTLIHQSITGLYETRIDLGKL-- | 1367 |
| WP_050881965 | 1307 LAN---NII NLFTFTSLGAP-AAFKFFD--KII--DRK--R-YTSTKEVL | NSTLIHQSITGLYETRIDLGKL-- | 1367 |
| WP_050886065 | 1307 LAN---NII NLFTFTSLGAP-AAFKFFD--KIV--DRK--R-YTSTKEVL | NSTLIHQSITGLYETRIDLGKL-- | 1367 |
| AHN30376 | 1307 LAK---NII NLFTFTSLGAP-AAFKFFD--KSV--DRK--R-YTSTKEVL | DSTLIHQSITGLYETRIDLGKL-- | 1367 |
| EAO78426 | 1307 LAN---NII NLFTFTSLGAP-AAFKFFD--KIV--DRK--R-YTSTKEVL | NSTLIHQSITGLYETRIDLGKL-- | 1367 |
| CCW42055 | 1307 LAN---NII NLFTFTSLGAP-AAFKFFD--KIV--DRK--R-YTSTKEVL | NSTLIHQSITGLYETRIDLGKL-- | 1367 |
| WP_003041502 | 1314 ICT---SFL GLFELTSLGSA-SDFEFLG--VKI--PRY--RdYTPSSLLK | DSTLIHQSITGLYETRIDLSKL-- | 1383 |
| WP_037593752 | 1283 LAK---SFI SLLTFTAFGAP-AAFNFFG--ENI--DRK--R-YTSVTECL | NATLIHQSITGLYETRIDLSKL-- | 1343 |
| WP_049516684 | 1283 LAK---SFI SLLTFTAFGAP-AAFNFFG--ENI--DRK--R-YTSVTECL | NATLIHQSITGLYETRIDLSKL-- | 1343 |
| GAD46167 | 1282 LAK---SFI SLLTFTAFGAP-AAFNFFG--ENI--DRK--R-YTSVTECL | NATLIHQSITGLYETRIDLSKL-- | 1342 |
| WP_018363470 | 1314 ISD---SFI NLLTLTALGAP-ADFNFLG--EKI--PRK--R-YNSTKECL | NATLIHQSITGLYETRIDLSKL-- | 1374 |
| WP_003043819 | 1311 -SN---SFV SLLKYTSFGAS-GGFTFLD--LDVkqGRL--R-YQTVTEVL | DATLIYQSITGLYETRTDLSQL-- | 1372 |
| WP_006269658 | 1282 LAK---SFI SLLTFTAFGAP-AAFNFFG--ENI--DRK--R-YTSVTECL | NATLIHQSITGLYETRIDLSKL-- | 1342 |
| WP_048800889 | 1302 ISN---SFI HLLTLTALGAP-ADFNFLG--EKI--PRK--R-YTSTKECL | NATLIHQSITGLYETQTDLSKL-- | 1362 |
| WP_012767106 | 1309 -CS---SVI NLLTLTASGAP-ADFKFLG--TTI--PRK--R-YGSPQSIL | SSTLIHQSITGLYETRIDLSQL-- | 1368 |
| WP_014612333 | 1309 -CS---SVI NLLTLTASGAP-ADFKFLG--TTI--PRK--R-YGSPQSIL | SSTLIHQSITGLYETRIDLSQL-- | 1368 |
| WP_015017095 | 1309 -CS---SVI NLLTLTASGAP-ADFKFLG--TTI--PRK--R-YGSPQSIL | SSTLIHQSITGLYETRIDLSQL-- | 1368 |
| WP_015057649 | 1309 -CS---SVI NLLTLTASGAP-ADFKFLG--TTI--PRK--R-YGSPQSIL | SSTLIHQSITGLYETRIDLSQL-- | 1368 |
| WP_048327215 | 1309 -CS---SVI NLLTLTASGAP-ADFKFLG--TTI--PRK--R-YGSPQSIL | SSTLIHQSITGLYETRIDLSQL-- | 1368 |
| WP_049519324 | 1309 -CS---SVI NLLTLTASGAP-ADFKFLG--TTI--PRK--R-YGSPQSIL | SSTLIHQSITGLYETRIDLSQL-- | 1368 |
| WP_012515931 | 1286 -AE---NII NVFTFVALGAP-AAFKFFD--ATI--DRK--R-YTSTKEVL | NATLIHQSVTGLYETRIDLSQL-- | 1345 |
| WP_021320964 | 1286 -AE---NII NVFTFVALGAP-AAFKFFD--ATI--DRK--R-YTSTKEVL | NATLIHQSVTGLYETRIDLSQL-- | 1345 |
| WP_037581760 | 1286 -AE---NII NVFTFVALGAP-AAFKFFD--ATI--DRK--R-YTSTKEVL | NATLIHQSVTGLYETRIDLSQL-- | 1345 |
| WP_004232481 | 1309 ISSlseSFI NLLKFISFGAP-GAFKFLK--LDV--KQSnlR-YKSTTEAL | SATLIHQSVTGLYETRIDLSKL-- | 1374 |
| WP_009854540 | 1307 ISN---SFI NLLTLTALGAP-ADFNFLG--EKI--PRK--R-YTSTKECL | TATLIHQSITGLYETRIDLSKL-- | 1367 |
| WP_012962174 | 1308 ISI---SFV NLLTLTALGAP-ADFNFLG--EKI--PRK--R-YTSTKECL | NATLIHQSITGLYETRIDLSKL-- | 1368 |
| WP_039695303 | 1309 ISN---SFI NLLTLTALGAP-ADFNFLG--EKI--PRK--R-YTSTKECL | NATLIHQSITGLYETRIDLSKL-- | 1369 |
| WP_014334983 | 1312 ISA---SFI NLLTLTALGAP-ADFNFLG--EKI--PRK--R-YTSTKECL | SATLIHQSVTGLYETRIDLSKL-- | 1372 |
| WP_003099269 | 1306 -AI---NML NLFTFTDLGAP-SAFKFFN--GDI--DRK--R-YSSTNEII | NSTLIYQSPTGLYETRIDLSKL-- | 1365 |
| AHY15608 | --------- ------------------------ ------------------------ | | |
| AHY17476 | --------- ------------------------ ------------------------ | | |
| ESR09100 | 138 -AI---NML NLFTFTDLGAP-SAFKFFNg--DI--DRK--R-YSSTNEII | NSTLIYQSPTGLYETRIDLSKL-- | 197 |
| AGM98575 | --------- ------------------------ ------------------------ | | |
| ALF27331 | 1282 LAS---SFI NLLTFTAIGAP-AAFKFFD--NNI--DRK--R-YTSTTEIL | NATLIHQSITGLYETRIDLSRL-- | 1342 |

-continued

| | | | |
|---|---|---|---|
| WP_018372492 | 1290 | VAR---SFV -LLNFTMMGAA-TDFKFFG--QII--PRK--R-YPSTTECL KSTLIHQSVTGLYETRIDLSKL-- | 1350 |
| WP_045618028 | 1311 | LSE---SFI SLLKLISFGAP-GTFKFLG--VEI--SQSnvR-YQSVSSCF NATLIHQSITGLYETRIDLSKL-- | 1373 |
| WP_045635197 | 1307 | LAN---SFI NLLTFTALGAP-AAFKFFG--KDI--DRK--R-YTTVSEIL NATLIHQSITGLYETWIDLSKL-- | 1367 |
| WP_002263549 | 1282 | LAS---SFI NLLTFTAIGAP-ATFKFFD--KNI--DRK--R-YTSTTEIL NATLIHQSITGLYETRIDLNKL-- | 1342 |
| WP_002263887 | 1282 | LAS---SFI NLLTFTAIGAP-ATFKFFD--KNI--DRK--R-YSTTEIL NATLIHQSITGLYETRIDLNKL-- | 1342 |
| WP_002264920 | 1282 | LAS---SFI NLLTFTAIGAP-ATFKFFD--KNI--DRK--R-YTSTTEIL NATLIHQSITGLYETRIDLSKL-- | 1342 |
| WP_002269043 | 1282 | LAS---SFI NLLTFTAIGAP-ATFKFFD--KNI--DRK--R-YTSTTEIL NATLIHQSITGLYETRIDLNKL-- | 1342 |
| WP_002269448 | 1282 | LAS---SFI NLLTFTAIGAP-ATFKFFD--KNI--DRK--R-YTSTTEIL NATLIHQSITGLYETRIDLSKL-- | 1342 |
| WP_002271977 | 1282 | LAS---SFI NLLTFTAIGAP-ATFKFFD--KNI--DRK--R-YTSTTEIL NATLIHQSITGLYETRIDLSKL-- | 1342 |
| WP_002272766 | 1282 | LAS---SFI NLLTFTAIGAP-ATFKFFD--KNI--DRK--R-YTSTTEIL NATLIHQSITGLYETRIDLSKL-- | 1342 |
| WP_002273241 | 1282 | LAS---SFI NLLTFTAIGAP-ATFKFFD--KNI--DRK--R-YTSTTECL NATLIHQSITGLYETRIDLSKL-- | 1342 |
| WP_002275430 | 1282 | LSS---SFI NLLTFTAIGAP-AAFKFFD--KNI--DRK--R-YTSTTEIL NATLIHQSITGLYETRIDLSKL-- | 1342 |
| WP_002276448 | 1282 | LAS---SFI NLLTFTAIGAP-ATFKFFD--KNI--DRK--R-YTSTTEIL NATLIHQSITGLYETRIDLSKL-- | 1342 |
| WP_002277050 | 1288 | LAD---GFI KLLGFTQLGAT-SPFSFLG--IKL--NQK--Q-YTGKKDYL EATLIHQSITGLYETRIDLNKL-- | 1352 |
| WP_002277364 | 1282 | LAS---SFI NLLTFTAIGAP-ATFKFFD--KNI--DRK--R-YTSTTEIL NATLIHQSITGLYETRIDLSKL-- | 1342 |
| WP_002279025 | 1282 | LAS---SFI NLLTFTAIGAP-ATFKFFD--KNI--DRK--R-YTSTTEIL NATLIHQSITGLYETRIDLSKL-- | 1342 |
| WP_002279859 | 1282 | LAS---SFI NLLTFTAIGAP-ATFKFFD--KNI--DRK--R-YTSTTEIL NATLIHQSITGLYETRIDLSKL-- | 1342 |
| WP_002280230 | 1282 | LAS---SFI NLLTFTAIGAP-ATFKFFD--KNI--DRK--R-YTSTTEIL NATLIHQSITGLYETRIDLSKL-- | 1342 |
| WP_002281696 | 1282 | LSS---SFI NLLTFTAIGAP-AAFKFFD--KNI--DRK--R-YTSTTEIL NATLIHQSITGLYETRIDLSKL-- | 1342 |
| WP_002282247 | 1288 | LAD---GFI KLLGFTQLGAT-SPFSFLG--IKL--NQK--Q-YTGKKDYL EATLIHQSITGLYETRIDLSKL-- | 1352 |
| WP_002282906 | 1282 | LAS---SFI NLLTFTAIGAP-ATFKFFD--KNI--DRK--R-YTSTTEIL NATLIHQSITGLYETRIDLSKL-- | 1342 |
| WP_002283846 | 1282 | LAS---SFI NLLTFTAIGAP-ATFKFFD--KNI--DRK--R-YTSTTEIL NATLIHQSITGLYETRIDLSKL-- | 1342 |
| WP_002287255 | 1282 | LAS---SFI NLLTFTAIGAP-ATFKFFD--KNI--DRK--R-YTSTTEIL NATLIHQSITGLYETRIDLSKL-- | 1342 |
| WP_002288990 | 1282 | LAS---SFI NLLTFTAIGAP-AAFKFFD--KNI--DRK--R-YTSTTEIL NATLIHQSITGLYETRIDLSKL-- | 1342 |
| WP_002289641 | 1282 | LAS---SFI NLLTFTAIGAP-ATFKFFD--KNI--DRK--R-YTSTTEIL NATLIHQSITGLYETRIDLSKL-- | 1342 |
| WP_002290427 | 1282 | LAS---SFI NLLTFTAIGAP-ATFKFFD--KNI--DRK--R-YTSTTEIL NATLIHQSITGLYETRIDLSKL-- | 1342 |
| WP_002295753 | 1282 | LAS---SFI NLLTFTAIGAP-AAFKFFD--KNI--DRK--R-YTSTTEIL NATLIHQSITGLYETRIDLSKL-- | 1342 |
| WP_002296423 | 1282 | LAS---SFI NLLTFTAIGAP-ATFKFFD--KNI--DRK--R-YTSTTEIL NATLIHQSITGLYETRIDLSKL-- | 1342 |
| WP_002304487 | 1296 | LAS---SFI NLLTFTAIGAP-AAFKFFD--KNI--DRK--R-YTSTTEIL NATLIHQSITGLYETRIDLNKL-- | 1356 |
| WP_002305844 | 1282 | LAS---SFI NLLTFTAIGAP-ATFKFFD--KNI--DRK--R-YTSTTEIL NATLIHQSITGLYETRIDLSKL-- | 1342 |
| WP_002307203 | 1282 | LAS---SFI NLLTFTAIGAP-ATFKFFD--KNI--DRK--R-YTSTTEIL NATLIHQSITGLYETRIDLSKL-- | 1342 |
| WP_002310390 | 1282 | LAS---SFI NLLTFTAIGAP-ATFKFFD--KNI--DRK--R-YTSTTEIL NATLIHQSITGLYETRIDLSKL-- | 1342 |
| WP_002352408 | 1282 | LAS---SFI NLLTFTAIGAP-ATFKFFD--KNI--DRK--R-YTSTTEIL NATLIHQSITGLYETRIDLSKL-- | 1342 |
| WP_012997688 | 1282 | LAS---SFI NLLTFTAIGAP-ATFKFFD--KNI--DRK--R-YTSTTEIL NATLIHQSITGLYETRIDLSKL-- | 1342 |
| WP_014677909 | 1282 | LAS---SFI NLLTFTAIGAP-ATFKFFD--KNI--DRK--R-YTSTTEIL NATLIHQSITGLYETRIDLSKL-- | 1342 |
| WP_019312892 | 1282 | LAS---SFI NLLTFTAIGAP-ATFKFFD--KNI--DRK--R-YTSTTEIL NATLIHQSITGLYETRIDLSKL-- | 1342 |
| WP_019313659 | 1282 | LAS---SFI NLLTFTAIGAP-ATFKFFD--KNI--DRK--R-YTSTTEIL NATLIHQSITGLYETRIDLNKL-- | 1342 |
| WP_019314093 | 1282 | LAS---SFI NLLTFTAIGAP-AAFKFFD--KNI--DRK--R-YTSTTEIL NATLIHQSITGLYETRIDLSKL-- | 1342 |
| WP_019315370 | 1282 | LSS---SFI NLLTFTAIGAP-AAFKFFD--KNI--DRK--R-YTSTTEIL NATLIHQSITGLYETRIDLSKL-- | 1342 |
| WP_019803776 | 1282 | LAS---SFI NLLTFTAIGAP-ATFKFFD--KNI--DRK--R-YTSTTEIL NATLIHQSITGLYETRIDLNKL-- | 1342 |

-continued

```
WP_019805234    1282 LAS---SFI NLLTFTAIGAP-ATFKFFD--KNI--DRK--R-YTSTTEIL NATLIHQSITGLYETRIDLSKL--    1342
WP_024783594    1282 LAS---SFI NLLTFTAIGAP-ATFKFFD--KNI--DRK--R-YTSTTEIL NATLIHQSITGLYETRIDLNKL--    1342
WP_024784288    1288 LAD---GFI KLLGFTQLGAT-SPFSFLG--IKL--NQK--Q-YTGKKDYL EATLIHQSITGLYETRIDLSKL--    1352
WP_024784666    1282 LAS---SFI NLLTFTAIGAP-ATFKFFD--KNI--DRK--R-YTSTTEIL NATLIHQSITGLYETRIDLSKL--    1342
WP_024784894    1282 LAS---SFI NLLTFTAIGAP-ATFKFFD--KNI--DRK--R-YTSTTEIL NATLIHQSITGLYETRIDLSKL--    1342
WP_024786433    1288 LAD---GFI KLLGFTQLGAT-SPFSFLG--IKL--NQK--Q-YTGKKDYL EATLIHQSITGLYETRIDLSKL--    1352
WP_049473442    1282 LAS---SFI NLLTFTAIGAP-ATFKFFD--KNI--DRK--R-YTSTTEIL NATLIHQSITGLYETRIDLSKL--    1342
WP_049474547    1282 LAS---SFI NLLTFTAIGAP-ATFKFFD--KNI--DRK--R-YISTTEIL KATLIHQSITGLYETRIDLSKL--    1342
EMC03581        1275 LAS---SFI NLLTFTAIGAP-ATFKFFD--KNI--DRK--R-YTSTTEIL NATLIHQSITGLYETRIDLSKL--    1335
WP_000428612    1310 LAN---SFI NLLTFTALGAP-AAFKFFG--KDV--DRK--R-YTTVSEIL NATLIHQSITGLYETRIDLSKL--    1370
WP_000428613    1308 LAN---SFI NLLTFTALGAP-AAFKFFG--KDI--DRK--R-YTTVSEIL NATLIHQSITGLYETRIDLSKL--    1368
WP_049523028    1303 IAN---SFI NLLTFTAFGAP-AVFKFFG--KDI--ERK--R-YSTVTEIL KATLIHQSLTGLYETRIDLSKL--    1363
WP_003107102    1275 -AT---NML NLFTFTGLGAP-ATLKFFN--VDI--DRK--R-YTSSTEIL NSTLIRQSITGLYETRIDLSKI--    1334
WP_054279288    1304 -SI---SFL NLFKFTSFGAP-EKFTFLN--SEIkqDDV--R-YRSTKECL NSTLIHQSVTGLYETRIDLSQF--    1365
WP_049531101    1311 LSE---SFI SLLKLTSFGAP-GAFRFLG--VEI--SQSnvR-YQSVSSCF NATLIHQSITGLYETRIDLSKL--    1373
WP_049538452    1311 LSE---SFI SLLKLTSFGAP-GAFKFLG--VEI--SQSSVR-YKPNSQFL DATLIHQSITGLYETRIDLSKL--    1373
WP_049549711    1313 LSE---SFI SLLKLTSFGAP-GAFKFLG--AEI--SQSSVR-YKPNSQFL DTTLIHQSITGLYETRIDLSKL--    1375
WP_007896501    1312 -AL---NML NLFIFTSLGAP-STFVFFD--ETI--DRK--R-YTTSSDVL NGILIQQSITGLYETRIDLSRF--    1371
EFR44625        1264 -AL---NML NLFIFTSLGAP-STFVFFD--ETI--DRK--R-YTTSSDVL NGILIQQSITGLYETRIDLSRF--    1323
WP_002897477    1307 LAN---SFI NLLTFTALGAP-AAFKFFG--KDV--DRK--R-YTTVSEIL NATLIHQSITGLYETRIDLSKL--    1367
WP_002906454    1312 LSE---SFI SLLKLTSFGAP-GAFKFLG--VEI--SQSsvR-YKPNSQFL DTTLIHQSITGLYETRIDLSKL--    1374
WP_009729476    1308 LAN---SFI NLLTFTALGAP-AAFKFFG--KDV--DRK--R-YTTVSEIL NATLIHQSITGLYETRIDLSKL--    1368
COR24647        1296 LAQ---SFI SLLKFTAFGAP-GGFKFLD--ADI--KQSnlR-YQTVTEVL SSTLIHQSVTGLYETRIDLSKL--    1358
WP_000066813    1312 LAN---SFI NLLTFTALGAP-AAFKFFG--KDV--DRK--R-YTTVSEIL NATLIHQSITGLYETRIDLSKL--    1372
WP_009754323    1308 LAN---SFI NLLTFTALGAP-AAFKFFG--KDV--DRK--R-YTTVSEIL NATLIHQSITGLYETRIDLSKL--    1368
WP_044674937    1301 LTS---SFV NLLTFTAIGAP-AAFKFLG--SVI--DRK--R-YTSIAEIL EATLIHQSVTGLYETRIDLSKL--    1361
WP_044676715    1303 LTS---SFV NLLTFTAIGAP-AAFKFLG--SVI--DRK--R-YTSIAEIL EATLIHQSVTGLYETRIDLSKL--    1363
WP_044680361    1303 LTS---SFV NLLTFTAIGAP-AAFKFLG--SVI--DRK--R-YTSIAEIL EATLIHQSVTGLYETRIDLSKL--    1363
WP_044681799    1301 LTS---SFV NLLTFTAIGAP-AAFKFLG--SVI--DRK--R-YTSIAEIL EATLIHQSVTGLYETRIDLSKL--    1361
WP_049533112    1314 ICT---SFL GLFELTSLGSA-SDFEFLG--VKI--PRY--RdYTPSSLLK DSTLIHQSITGLYETRIDLSKL--    1383
WP_029090905    1241 -VK----VI ELLKITQANATnGDLKLLK----M-sNREg-R-LGSVSVAL DFKIINQSVTGLYQSIEDYNN---    1300
WP_006506696    1269 -AN----II QMLIVMHRGPQnGNIVYDDf--KI-sDRIg-R-LKTKNHNL NIVFISQSPTGIYTKKYKL-----    1329
AIT42264        1306 -AE---NII HLFTLTNLGAP-AAFKYFD--TTI--DRK--R-YTSTKEVL DATLIHQSITGLYETRIDLSQL--    1365
WP_034440723    1277 LVE---SFI NLLAITKCGPA-ADITFLG--EKI--SRK--R-YRSINCLW GSEVIFQSPTGLYETRLRLE----    1335
AKQ21048        1306 -AE---NII HLFTLTNLGAP-AAFKYFD--TTI--DRK--R-YTSTKEVL DATLIHQSITGLYETRIDLSQL--    1365
WP_004636532    1272 TVE---SFV NLMTFTAMGAP-ATFKFYG--ESI--TRS--R-YTSITEFR GSTLIFQSITGLYETRYKL-----    1329
WP_002364836    1278 IAA---SFI QLMQFNAMGAP-STFKFFQ--KDI--ERA--R-YTSIKEIF DATIIYQSTTGLYETRRKV-----    1335
WP_016631044    1229 IAA---SFI QLMQFNAMGAP-STFKFFQ--KDI--ERA--R-YTSIKEIF DATIIYQSPTGLYETRRKV-----    1286
EMS75795        1014 LSQ---SFI NLMQLNAMGAP-ADFKFFD--VII--PRK--R-YPSLTEIW ESTIIYQSITGLRETRTRMATLwd    1076
WP_002373311    1278 IAA---SFI QLMQFNAMGAP-STFKFFQ--KDI--ERA--R-YTSIKEIF DATIIYQSTTGLYETRRKV-----    1335
WP_002378009    1278 IAA---SFI QLMQFNAMGAP-STFKFFQ--KDI--ERA--R-YTSIKEIF DATIIYQSTTGLYETRRKV-----    1335
```

-continued

| | | | |
|---|---|---|---|
| WP_002407324 | 1278 | IAA---SFI QLMQFNAMGAP-STFKFFQ--KDI--ERA--R-YTSIKEIF DATIIYQSTTGLYETRRKV----- | 1335 |
| WP_002413717 | 1278 | IAA---SFI QLMQFNAMGAP-STFKFFQ--KDI--ERA--R-YTSIKEIF DATIIYQSTTGLYETRRKV----- | 1335 |
| WP_010775580 | 1280 | IAA---SFI QLMQFNAMGAP-STFKFFQ--KDI--ERA--R-YTSIKEIF DATIIYQSTTGLYETRRKV----- | 1337 |
| WP_010818269 | 1278 | IAA---SFI QLMQFNAMGAP-STFKFFQ--KDI--ERA--R-YTSIKEIF DATIIYQSTTGLYETRRKV----- | 1335 |
| WP_010824395 | 1278 | IAA---SFI QLMQFNAMGAP-STFKFFQ--KDI--ERA--R-YTSIKEIF DATIIYQSTTGLYETRRKV----- | 1335 |
| WP_016622645 | 127 | IAA---SFI QLMQFNAMGAP-STFKFFQ--KDI--ERA--R-YTSIKEIF DATIIYQSTTGLYETRRKV----- | 1335 |
| WP_033624816 | 1278 | IAA---SFI QLMQFNAMGAP-STFKFFQ--KDI--ERA--R-YTSIKEIF DATIIYQSTTGLYETRRKV----- | 1335 |
| WP_033625576 | 1278 | IAA---SFI QLMQFNAMGAP-STFKFFQ--KDI--ERA--R-YTSIKEIF DATIIYQSTTGLYETRRKV----- | 1335 |
| WP_033789179 | 1278 | IAA---SFI QLMQFNAMGAP-STFKFFQ--KDI--ERA--R-YTSIKEIF DATIIYQSTTGLYETRRKV----- | 1335 |
| WP_002310644 | 1280 | LAS---SFV NLMQFNAMGAP-ADFKFFD--VTI--PRK--R-YTSLTEIW QSTIIHQSITGLYETRIRMGK--- | 1339 |
| WP_002312694 | 1281 | LAS---SFV NLMQFNAMGAP-ADFKFFD--VTI--PRK--R-YTSLTEIW QSTIIHQSITGLYETRIRMGK--- | 1340 |
| WP_002314015 | 1281 | LAS---SFV NLMQFNAMGAP-ADFKFFD--VTI--PRK--R-YTSLTEIW QSTIIHQSITGLYETRIRMGK--- | 1340 |
| WP_002320716 | 1281 | LAS---SFV NLMQFNAMGAP-ADFKFFD--VTI--PRK--R-YTSLTEIW QSTIIHQSITGLYETRIRMGK--- | 1340 |
| WP_002330729 | 1280 | LAS---SFV NLMQFNAMGAP-ADFKFFD--VTI--PRK--R-YTSLTEIW QSTIIHQSITGLYETRIRMGK--- | 1339 |
| WP_002335161 | 1281 | LAS---SFV NLMQFNAMGAP-ADFKFFD--VTI--PRK--R-YTSLTEIW QSTIIHQSITGLYETRIRMGK--- | 1340 |
| WP_002345439 | 1281 | LAS---SFV NLMQFNAMGAP-ADFKFFD--VTI--PRK--R-YTSLTEIW QSTIIHQSITGLYETRIRMGK--- | 1340 |
| WP_034867970 | 1271 | IAQ---SFL QLLQFNAIGAP-ADFKFFG--VTI--PRK--R-YTSLTEIW DATIIYQSVTGLYETRIRMGDLwa | 1333 |
| WP_047937432 | 1281 | LAS---SFV NLMQFNAMGAP-ADFKFFD--VTI--PRK--R-YTSLTEIW QSTIIHQSITGLYETRIRMGK--- | 1340 |
| WP_010720994 | 1271 | IAQ---SFL QLLQFNAIGAP-ADFKFFG--VTI--PRK--R-YTSLTEIW DATIIYQSVTGLYETRIRMGDLwa | 1333 |
| WP_010737004 | 1271 | IAQ---SFL QLLQFNAIGAP-ADFKFFG--VTI--PRK--R-YTSLTEIW DATIIYQSVTGLYETRIRMGDLwa | 1333 |
| WP_034700478 | 1271 | IAQ---SFL QLLQFNAIGAP-ADFKFFG--VTI--PRK--R-YTSLTEIW DATIIYQSVTGLYETRIRMGDLwa | 1333 |
| WP_007209003 | 1270 | IAK---SFI NLLTFTAMGAP-ADFEFFG--EKI--PRK--R-YVSISEII DAVFIHQSITGLYETRVRLTEV-- | 1330 |
| WP_023519017 | 1265 | MID---AIL SLLKFTLFGAS-VEFKFFD--IKI---LK--R-YKSLTDIW EATIIYQSVTGLYERRVEVRKLwd | 1326 |
| WP_010770040 | 1275 | IAE---SFV NLMKFSAYGAP-MDFKFFG--KTI--PRS--R-YTSVGELL SATIINQSITGLYETRRKL----- | 1332 |
| WP_048604708 | 1271 | IAQ---SFV DLMQLNAFGAP-ADFKFFG--ETI--PRK--R-YTSVNELL EATIINQSITGLYETRRRL----- | 1328 |
| WP_010750235 | 1274 | MAH---SFV NLMQFNALGAP-ADFKFFD--TTI--TRK--R-YTSLTEIW QSTIIYQSVTGLYETRRRMADLwd | 1336 |
| AII16583 | 1345 | -AE---NII HLFTLTNLGAP-AAFKYFD--TTI--DRK--R-YTSTKEVL DATLIHQSITGLYETRIDLSQL-- | 1404 |
| WP_029073316 | 1283 | -CE----VI QMLVVMHAGPQnGNITFDDf--KL-SNRLg-R-LNCKTISL TTVFIADSPTGMY SKKYKL---- | 1343 |
| WP_031589969 | 1284 | -CN----II QILATLHCNSSiGKIMYSDf--KI-STTIg-R-LNGRTISL DISFIAESPTGMYSKKYKL----- | 1344 |
| KDA45870 | 1254 | LGK---NFV ELLRYTADGAA-SDFKFFG--ENI--PRK--R-YNSAGSLL NGTLIYQSKTGLYETRIDLGKL-- | 1314 |
| WP_039099354 | 1307 | ILDr----V -LIGLHANAAV-SDLGVLKisTPL--GKM--Q---QPSGIS DTQIIYQSPTGLFERRVALRDL-- | 1368 |
| AKP02966 | 1297 | INS1-eELI TLLHANSTSAH-LIFNNIE-KKAF--GRK-------THGLT DTDFIYQSVTGLYETRIHIE---- | 1356 |
| WP_010991369 | 1275 | IAQ---SFV DLMAFNAMGAP-ASFKFFE--TTI--ERK--R-YNNLKELL NSTIIYQSITGLYESRKRL----- | 1332 |
| WP_033838504 | 1275 | IAQ---SFV DLMAFNAMGAP-ASFKFFE--TTI--ERK--R-YNNLKELL NSTIIYQSITGLYESRKRL----- | 1332 |
| EHN60060 | 1278 | IAQ---SFV DLMAFNAMGAP-ASFKFFE--TTI--ERK--R-YNNLKELL NSTIIYQSITGLYESRKRL----- | 1335 |
| EFR89594 | 1044 | IAQ---SFV DLMAFNAMGAP-ASFKFFE--TTI--ERK--R-YNNLKELL NSTIIYQSITGLYESRKRL----- | 1101 |
| WP_038409211 | 1275 | IAK---SFD KLKVFNAFGAP-RDFEFFE--TTI--KRK--R-YYNIKELL NATIIYQSITGLYEARKRL----- | 1332 |
| EFR95520 | 894 | IAK---SFD KLKVFNAFGAP-RDFEFFE--TTI--KRK--R-YYNIKELL NATIIYQSITGLYEARKRL----- | 951 |
| WP_003723650 | 1275 | IAQ---SFV DLMAFNAMGAP-ASFKFFE--ATI--DRK--R-YTNLKELL SSTIIYQSITGLYESRKRL----- | 1332 |
| WP_003727705 | 1275 | TAQ---SFV DLMAFNAMGAP-ASFKFFE--ATI--DRK--R-YTNLKELL SSTIIYQSITGLYESRKRL----- | 1332 |

-continued

```
WP_003730785    1275 IAQ---SFV DLMAFNAMGAP-ASFKFFE--ATI--DRK--R-YTNLKELL SSTIIYQSITGLYESRKRL-----    1332

WP_003733029    1275 IAE---SFV SLKKFNAFGVH-QDFSFFG--TKI--ERK--R-DRKLNELL NSTIIYQSITGLYESRKRL-----    1332

WP_003739838    1275 IAQ---SFV NLMAFNAMGAP-ASFKFFE--ATI--ERK--R-YTNLKELL SATIIYQSITGLYEARKRL-----    1332

WP_014601172    1275 IAQ---SFV DLMAFNAMGAP-ASFKFFE--ATI--DRK--R-YTNLKELL SSTIIYQSITGLYESRKRL-----    1332

WP_023548323    1275 IAE---SFV SLKKFNAFGVH-KDENFFG--TTI--KRK--R-DRKLKELL NSTIIYQSITGLYESRKRL-----    1332

WP_031665337    1275 IAQ---SFV DLMAFNAMGAP-ASFKFFE--ATI--DRK--R-YTNLKELL SSTIIYQSITGLYESRKRL-----    1332

WP_031669209    1275 IAE---SFV SLKKFNAFGVH-QDFSFFG--TKI--ERK--R-DRKLNELL NSTIIYQSITGLYESRKRL-----    1332

WP_033920898    1275 IAE---SFV SLKKFNAFGVH-KDFNFFG--TTI--KRK--R-DRKLKELL NSTIIYQSITGLYESRKRL-----    1332

AKI42028        1278 IAQ---SFV DLMAFNAMGAP-ASFKFFE--ATI--DRK--R-YTNLKELL SSTIIYQSITGLYESRKRL-----    1335

AKI50529        1278 IAE---SFV SLKKFNAFGVH-KDFNFFG--TTI--KRK--R-DRKLKELL NSTIIYQSITGLYESRKRL-----    1335

EFR83390         723 IAQ---SFV DLMVFNAMGAP-ASFKFFE--ATI--DRK--R-YTNLKELL SSTIIYQSITGLYESRKRL-----     780

WP_046323366    1275 IAQ---SFV NLLEFNAMGAP-ASFKYFE--TNI--ERK--R-YNNLKELL NATIIYQSITGLYEARKRL-----    1332

AKE81011        1322 -AE---NII HLFTLTNLGAP-AAFKYFD--TTI--DRK--R-YTSTKEVL DATLIHQSITGLYETRIDLSQL--    1381

CUO82355        1273 -AN----VI QMLIIMHKGPQnGNIIYDDf--NV-gKRIg-R-LNGRTFYL NIEFISQSPTGIYTKKYKL-----    1333

WP_033162887    1275 -CD----VI QILIIMHAGPMnGNIMYDDf--KF-tNRIg-R-FTHKNIDL KTTFISTSVTGLF SKKYKL----    1335

AGZ01981        1339 -AE---NII HLFTLTNLGAP-AAFKYFD--TTI--DRK--R-YTSTKEVL DATLIHQSITGLYETRIDLSQL--    1398

AKA60242        1306 -AE---NII HLFTLTNLGAP-AAFKYFD--TTI--DRK--R-YTSTKEVL DATLIHQSITGLYETRIDLSQL--    1365

AKS40380        1306 -AE---NII HLFTLTNLGAP-AAFKYFD--TTI--DRK--R-YTSTKEVL DATLIHQSITGLYETRIDLSQL--    1365

4UN5_B          1310 -AE---NII HLFTLTNLGAP-AAFKYFD--TTI--DRK--R-YTSTKEVL DATLIHQSITGLYETRIDLSQL--    1369

WP_010922251    1366 GGD                                                                          1368

WP_039695303    1370 GEE                                                                          1372

WP_045635197    1368 GED                                                                          1370

5AXW_A               ---

WP_009880683    1050 GGD                                                                          1052

WP_010922251    1366 GGD                                                                          1368

WP_011054416    1366 GGD                                                                          1368

WP_011284745    1366 GGD                                                                          1368

WP_011285506    1366 GGD                                                                          1368

WP_011527619    1366 GGD                                                                          1368

WP_012560673    1366 GGD                                                                          1368

WP_014407541    1365 GGD                                                                          1367

WP_020905136    1366 GGD                                                                          1368

WP_023080005    1365 GGD                                                                          1367

WP_023610282    1365 GGD                                                                          1367

WP_030125963    1366 GGD                                                                          1368

WP_030126706    1366 GGD                                                                          1368

WP_031488318    1366 GGD                                                                          1368

WP_032460140    1366 GGD                                                                          1368

WP_032461047    1366 GGD                                                                          1368

WP_032462016    1366 GGD                                                                          1368

WP_032462936    1366 GGD                                                                          1368
```

-continued

| | | |
|---|---|---|
| WP_032464890 | 1366 GGD | 1368 |
| WP_033888930 | 1191 GGD | 1193 |
| WP_038431314 | 1366 GGD | 1368 |
| WP_038432938 | 1365 GGD | 1367 |
| WP_038434062 | 1366 GGD | 1368 |
| BAQ51233 | 1277 GGD | 1279 |
| KGE60162 | 541 GGD | 543 |
| KGE60856 | 304 GGD | 306 |
| WP_002989955 | 1366 GGD | 1368 |
| WP_003030002 | 1343 GED | 1345 |
| WP_003065552 | 1371 GEE | 1373 |
| WP_001040076 | 1368 GED | 1370 |
| WP_001040078 | 1376 GED | 1378 |
| WP_001040080 | 1368 GED | 1370 |
| WP_001040081 | 1368 GED | 1370 |
| WP_001040083 | 1368 GED | 1370 |
| WP_001040085 | 1368 GED | 1370 |
| WP_001040087 | 1368 GED | 1370 |
| WP_001040088 | 1368 GGD | 1370 |
| WP_001040089 | 1368 GED | 1370 |
| WP_001040090 | 1368 GED | 1370 |
| WP_001040091 | 1368 GED | 1370 |
| WP_001040092 | 1368 GED | 1370 |
| WP_001040094 | 1368 GED | 1370 |
| WP_001040095 | 1368 GEG | 1370 |
| WP_001040096 | 1368 GEG | 1370 |
| WP_001040097 | 1368 GED | 1370 |
| WP_001040098 | 1368 GED | 1370 |
| WP_001040099 | 1368 GED | 1370 |
| WP_001040100 | 1368 GED | 1370 |
| WP_001040104 | 1368 GED | 1370 |
| WP_001040105 | 1368 GED | 1370 |
| WP_001040106 | 1368 GED | 1370 |
| WP_001040107 | 1368 GED | 1370 |
| WP_001040108 | 1368 GED | 1370 |
| WP_001040109 | 1368 GED | 1370 |
| WP_001040110 | 1368 GED | 1370 |
| WP_015058523 | 1368 GED | 1370 |
| WP_017643650 | 1368 GED | 1370 |
| WP_017647151 | 1368 GED | 1370 |

-continued

| | | |
|---|---|---|
| WP_017648376 | 1368 GED | 1370 |
| WP_017649527 | 1368 GED | 1370 |
| WP_017771611 | 1368 GED | 1370 |
| WP_017771984 | 1368 GED | 1370 |
| CFQ25032 | 1368 GED | 1370 |
| CFV16040 | 1368 GED | 1370 |
| KLJ37842 | 1368 GED | 1370 |
| KLJ72361 | 1368 GGD | 1370 |
| KLL20707 | 1382 GED | 1384 |
| KLL42645 | 1368 GED | 1370 |
| WP_047207273 | 1368 GED | 1370 |
| WP_047209694 | 1368 GED | 1370 |
| WP_050198062 | 1368 GED | 1370 |
| WP_050201642 | 1368 GED | 1370 |
| WP_050204027 | 1368 GED | 1370 |
| WP_050881965 | 1368 GED | 1370 |
| WP_050886065 | 1368 GED | 1370 |
| AHN30376 | 1368 GED | 1370 |
| EAO78426 | 1368 GED | 1370 |
| CCW42055 | 1368 GED | 1370 |
| WP_003041502 | 1384 GED | 1386 |
| WP_037593752 | 1344 GED | 1346 |
| WP_049516684 | 1344 GED | 1346 |
| GAD46167 | 1343 GED | 1345 |
| WP_018363470 | 1375 GEE | 1377 |
| WP_003043819 | 1373 GGD | 1375 |
| WP_006269658 | 1343 GED | 1345 |
| WP_048800889 | 1363 GED | 1365 |
| WP_012767106 | 1369 GGD | 1371 |
| WP_014612333 | 1369 GGD | 1371 |
| WP_015017095 | 1369 GGD | 1371 |
| WP_015057649 | 1369 GGD | 1371 |
| WP_048327215 | 1369 GGD | 1371 |
| WP_049519324 | 1369 GGD | 1371 |
| WP_012515931 | 1346 GEN | 1348 |
| WP_021320964 | 1346 GEN | 1348 |
| WP_037581760 | 1346 GEN | 1348 |
| WP_004232481 | 1375 GEE | 1377 |
| WP_009854540 | 1368 GEE | 1370 |
| WP_012962174 | 1369 GEE | 1371 |
| WP_039695303 | 1370 GEE | 1372 |

-continued

| | | | |
|---|---|---|---|
| WP_014334983 | 1373 GEE | | 1375 |
| WP_003099269 | 1366 GGK | | 1368 |
| AHY15608 | --- | | |
| AHY17476 | --- | | |
| ESR09100 | 198 GGK | | 200 |
| AGM98575 | --- | | |
| ALF27331 | 1343 GGD | | 1345 |
| WP_018372492 | 1351 GEN | | 1353 |
| WP_045618028 | 1374 GED | | 1376 |
| WP_045635197 | 1368 GED | | 1370 |
| WP_002263549 | 1343 GGD | | 1345 |
| WP_002263887 | 1343 GGD | | 1345 |
| WP_002264920 | 1343 GGD | | 1345 |
| WP_002269043 | 1343 GGD | | 1345 |
| WP_002269448 | 1343 GGD | | 1345 |
| WP_002271977 | 1343 GGD | | 1345 |
| WP_002272766 | 1343 GGD | | 1345 |
| WP_002273241 | 1343 GGD | | 1345 |
| WP_002275430 | 1343 GGD | | 1345 |
| WP_002276448 | 1343 GGD | | 1345 |
| WP_002277050 | 1353 GGD | | 1355 |
| WP_002277364 | 1343 GGD | | 1345 |
| WP_002279025 | 1343 GGD | | 1345 |
| WP_002279859 | 1343 GGD | | 1345 |
| WP_002280230 | 1343 GGD | | 1345 |
| WP_002281696 | 1343 GGD | | 1345 |
| WP_002282247 | 1353 GGD | | 1355 |
| WP_002282906 | 1343 GGD | | 1345 |
| WP_002283846 | 1343 GGD | | 1345 |
| WP_002287255 | 1343 GGD | | 1345 |
| WP_002288990 | 1343 GGD | | 1345 |
| WP_002289641 | 1343 GGD | | 1345 |
| WP_002290427 | 1343 GGD | | 1345 |
| WP_002295753 | 1343 GGD | | 1345 |
| WP_002296423 | 1343 GGD | | 1345 |
| WP_002304487 | 1357 GGD | | 1359 |
| WP_002305844 | 1343 GGD | | 1345 |
| WP_002307203 | 1343 GGD | | 1345 |
| WP_002310390 | 1343 GGD | | 1345 |
| WP_002352408 | 1343 GGD | | 1345 |

-continued

| | | |
|---|---|---|
| WP_012997688 | 1343 GGD | 1345 |
| WP_014677909 | 1343 GGD | 1345 |
| WP_019312892 | 1343 GGD | 1345 |
| WP_019313659 | 1343 GGD | 1345 |
| WP_019314093 | 1343 GGD | 1345 |
| WP_019315370 | 1343 GGD | 1345 |
| WP_019803776 | 1343 GGD | 1345 |
| WP_019805234 | 1343 GGD | 1345 |
| WP_024783594 | 1343 GGD | 1345 |
| WP_024784288 | 1353 GGD | 1355 |
| WP_024784666 | 1343 GGD | 1345 |
| WP_024784894 | 1343 GGD | 1345 |
| WP_024786433 | 1353 GGD | 1355 |
| WP_049473442 | 1343 GGD | 1345 |
| WP_049474547 | 1343 GGD | 1345 |
| EMC03581 | 1336 GGD | 1338 |
| WP_000428612 | 1371 GED | 1373 |
| WP_000428613 | 1369 GED | 1371 |
| WP_049523028 | 1364 GEE | 1366 |
| WP_003107102 | 1335 GGD | 1337 |
| WP_054279288 | 1366 GGD | 1368 |
| WP_049531101 | 1374 GED | 1376 |
| WP_049538452 | 1374 GED | 1376 |
| WP_049549711 | 1376 GED | 1378 |
| WP_007896501 | 1372 GGD | 1374 |
| EFR44625 | 1324 GGD | 1326 |
| WP_002897477 | 1368 GEE | 1370 |
| WP_002906454 | 1375 GED | 1377 |
| WP_009729476 | 1369 GED | 1371 |
| CQR24647 | 1359 GGE | 1361 |
| WP_000066813 | 1373 GED | 1375 |
| WP_009754323 | 1369 GED | 1371 |
| WP_044674937 | 1362 GGD | 1364 |
| WP_044676715 | 1364 GGD | 1366 |
| WP_044680361 | 1364 GGD | 1366 |
| WP_044681799 | 1362 GGD | 1364 |
| WP_049533112 | 1384 GED | 1386 |
| WP_029090905 | --- | |
| WP_006506696 | --- | |
| AIT42264 | 1366 GGD | 1389 |
| WP_034440723 | --- | |

-continued

| | | | |
|---|---|---|---|
| AKQ21048 | 1366 GGD | | 1384 |
| WP_004636532 | 1330 -ED | | 1332 |
| WP_002364836 | 1336 -VD | | 1337 |
| WP_016631044 | 1287 -VD | | 1288 |
| EMS75795 | 1077 GEQ | | 1079 |
| WP_002373311 | 1336 -VD | | 1337 |
| WP_002378009 | 1336 -VD | | 1337 |
| WP_002407324 | 1336 -VD | | 1337 |
| WP_002413717 | 1336 -VD | | 1337 |
| WP_010775580 | 1338 -VD | | 1339 |
| WP_010818269 | 1336 -VD | | 1337 |
| WP_010824395 | 1336 -VD | | 1337 |
| WP_016622645 | 1336 -VD | | 1337 |
| WP_033624816 | 1336 -VD | | 1337 |
| WP_033625576 | 1336 -VD | | 1337 |
| WP_033789179 | 1336 -VD | | 1337 |
| WP_002310644 | --- | | |
| WP_002312694 | --- | | |
| WP_002314015 | --- | | |
| WP_002320716 | --- | | |
| WP_002330729 | --- | | |
| WP_002335161 | --- | | |
| WP_002345439 | --- | | |
| WP_034867970 | 1334 GEQ | | 1336 |
| WP_047937432 | --- | | |
| WP_010720994 | 1334 GEQ | | 1336 |
| WP_010737004 | 1334 GEQ | | 1336 |
| WP_034700478 | 1334 GEQ | | 1336 |
| WP_007209003 | --- | | |
| WP_023519017 | 1327 GER | | 1330 |
| WP_010770040 | 1333 -VD | | 1334 |
| WP_048604708 | 1329 -GD | | 1330 |
| WP_010750235 | 1337 GVQ | | 1339 |
| AII16583 | 1405 GGD | | 1424 |
| WP_029073316 | --- | | |
| WP_031589969 | --- | | |
| KDA45870 | --- | | |
| WP_039099354 | --- | | |
| AKP02966 | --- | | |
| WP_010991369 | 1333 -DD | | 1334 |

-continued

| | | | |
|---|---|---|---|
| WP_033838504 | 1333 -DD | | 1334 |
| EHN60060 | 1336 -DD | | 1337 |
| EFR89594 | 1102 -DD | | 1103 |
| WP_038409211 | 1333 -ED | | 1334 |
| EFR95520 | 952 -ED | | 953 |
| WP_003723650 | 1333 -DD | | 1334 |
| WP_003727705 | 1333 -DD | | 1334 |
| WP_003730785 | 1333 -DD | | 1334 |
| WP_003733029 | 1333 -DN | | 1334 |
| WP_003739838 | 1333 -DG | | 1334 |
| WP_014601172 | 1333 -DD | | 1334 |
| WP_023548323 | 1333 -DS | | 1334 |
| WP_031665337 | 1333 -DD | | 1334 |
| WP_031669209 | 1333 -DN | | 1334 |
| WP_033920898 | 1333 -DS | | 1334 |
| AKI42028 | 1336 -DD | | 1337 |
| AKI50529 | 1336 -DS | | 1337 |
| EFR83390 | 781 -DD | | 782 |
| WP_046323366 | 1333 -DD | | 1334 |
| AKE81011 | 1382 GGD | | 1400 |
| CUO82355 | --- | | |
| WP_033162887 | --- | | |
| AGZ01981 | 1399 GGD | | 1417 |
| AKA60242 | 1366 GGD | | 1368 |
| AKS40380 | 1366 GGD | | 1376 |
| 4UN5_B | 1370 GGD | | 1372 |

EQUIVALENTS AND SCOPE, INCORPORATION BY REFERENCE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

SEQUENCE LISTING (5530 sequences)

SEQ ID NO: 1 - protein, 167 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 2 - protein, 8 aa, synthetic construct
SGGSSGGS

SEQ ID NO: 3 - protein, 84 aa, synthetic construct
MTNLSDIIEKETGKQLVIQESILMLPEEVEEVIGNKPESDILVHTAYDESTDENVMLLTSDAPEYKPWALVIQDSNGENKIKML

SEQ ID NO: 4 - protein, 7 aa, synthetic construct
PKKKRKV

SEQ ID NO: 5 - protein, 30 aa, synthetic construct
MDSLLMNRRKFLYQFKNVRWAKGRRETYLC

SEQ ID NO: 6 - DNA, 23 bp, synthetic construct
  source 1..23: mol_type = other DNA
gaacacaaagcatagactgcggg

SEQ ID NO: 7 - DNA, 23 bp, synthetic construct
  source 1..23: mol_type = other DNA
gaacacaaagcatagactgctgg

SEQ ID NO: 8 - protein, 160 aa, Staphylococcus aureus
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 9 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 10 - protein, 16 aa, synthetic construct
SGSETPGTSESATPES

SEQ ID NO: 11 - protein, 1561 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 12 - protein, 1561 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 13 - protein, 1561 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 14 - protein, 1561 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 15 - protein, 1648 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 16 - protein, 1648 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 17 - protein, 1648 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 18 - protein, 1648 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 19 - protein, 1648 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 20 - protein, 1648 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSTNLSDIIEKETGKQLVIQESILMLPEEVEEVIGNKPESDILVHTAYDESTDENVMLLTSDAPEYKPWALVIQDSNGENKIKMLSGGSPKKKRKV

SEQ ID NO: 21 - protein, 1784 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 22 - protein, 1784 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 23 - protein, 1784 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSKGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQASGGSPKKKRKV

SEQ ID NO: 24 - protein, 1787 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 25 - protein, 1787 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 26 - protein, 1787 aa, synthetic construct
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSDLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQPSGGSPKKKRKV

SEQ ID NO: 27 - protein, 1550 aa, synthetic construct
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 28 - protein, 1550 aa, synthetic construct
MSEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQXIKAQKKAQSSTDSGSETPGTSESATPESDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 29 - protein, 181 aa, Erwinia tasmaniensis
MASRGVNKVILVGNLGQDPEVRYMPNGGAVANITLATSESWRDKQTGETKEKTEWHRVVLFGKLAEVAGEYLRKGSQVYIEGALQTRKWTDQAGVEKYTTEVVVNVGGTMQMLGGRSQGGGASAGGQNGGSNNGWGQPQQPQGGNQFSGGAQQQARPQQQPQQNNAPANNEPPIDFDDDIP

SEQ ID NO: 30 - protein, 209 aa, synthetic construct
MAGAQDFVPHTADLAELAAAAGECRGCGLYRDATQAVFGAGGRSARIMMIGEQPGDKEDLAGLPFVGPAGRLLDRALEAADIDRDALYVTNAVKHFKFTRAAGGKRRIHKTPSRTEVVACRPWLIAEMTSVEPDVVVLLGATAAKALLGNDFRVTQHRGEVLHVDDVPGDPALVATVHPSSLLRGPKEERESAFAGLVDDLRVAADVRP

SEQ ID NO: 31 - protein, 313 aa, synthetic construct
MIGQKTLYSFFSPSPARKRHAPSPEPAVQGTGVAGVPEESGDAAAIPAKKAPAGQEEPGTPPSSPLSAEQLDRIQRNKAAALLRLAARNVPVGFGESWKKHLSGEFGKPYFIKLMGFVAEERKHYTVYPPPHQVFTWTQMCDIKDVKVVILGQEPYHGPNQAHGLCFSVQRPVPPPPSLENIYKELSTDIEDFVHPGHGDLSGWAKQGVLLLNAVLTVRAHQANSHKERGWEQFTDAVVSWLNQNSNGLVFLLWGSYAQKKGSAIDRKRHHVLQTAHPSPLSVYRGFFGCRHFSKTNELLQKSGKKPIDWKEL

SEQ ID NO: 32 - protein, 219 aa, synthetic construct
KGHLTRLGLEFFDQPAVPLARAFLGQVLVRRLPNGTELRGRIVETQAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 33 - protein, 222 aa, synthetic construct
DLASLRAQQIELASSVIREDRLDKDPPDLIAGAAVGFEQGGEVTRAAMVLLKYPSLELVEYKVARIATTMPYIPGFLSFREYPALLAAWEMLSQKPDLVFVDGHGISHPRRLGVASHFGLLVDVPTIGVAKKRLCGKFEPLSSEPGALAPLMDKGEQLAWVWRSKARCNPLFIATGHRVSVDSALAWVQRCMKGYRLPEPTRWADAVASERPAFVRYTANQP

SEQ ID NO: 34 - protein, 1367 aa, synthetic construct
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 35 - protein, 1367 aa, synthetic construct
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 36 - protein, 1367 aa, synthetic construct
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 37 - protein, 4 aa, synthetic construct
SGGS

SEQ ID NO: 38 - protein, 4 aa, synthetic construct
GGGS

SEQ ID NO: 39 - protein, 5 aa, synthetic construct
GGGGS

SEQ ID NO: 40 - protein, 5 aa, synthetic construct
EAAAK

SEQ ID NO: 41 - DNA, 23 bp, synthetic construct
  source 1..23: mol_type = other DNA
cccgcagtctatgctttgtgttc

SEQ ID NO: 42 - DNA, 23 bp, synthetic construct
  source 1..23: mol_type = other DNA
ggcccagactgagcacgtgatgg

SEQ ID NO: 43 - DNA, 23 bp, synthetic construct
  source 1..23: mol_type = other DNA
ggcactgcggctggaggtggggg

SEQ ID NO: 44 - DNA, 23 bp, synthetic construct
  source 1..23: mol_type = other DNA
gtcatcttagtcaggacctgagg

SEQ ID NO: 45 - DNA, 23 bp, synthetic construct
  source 1..23: mol_type = other DNA
ggaatcccttctgcagcacctgg

SEQ ID NO: 46 - DNA, 23 bp, synthetic construct
  source 1..23: mol_type = other DNA
gagtccgagcagaagaagaaggg

SEQ ID NO: 47 - DNA, 4104 bp, Streptococcus pyogenes
  source 1..4104: mol_type = genomic DNA
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 48 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 49 - DNA, 4212 bp, synthetic construct
  source 1..4212: mol_type = other DNA
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 50 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 51 - DNA, 4107 bp, Streptococcus pyogenes
  source 1..4107: mol_type = genomic DNA
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 52 - protein, 1368 aa, Streptococcus pyogenes [sequence omitted]

SEQ ID NO: 53 - protein, 1368 aa, synthetic construct
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1368 aa, synthetic construct; identical to SEQ ID NO: 53

SEQ ID NO: 55 - protein, 1052 aa, synthetic construct
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 56 - protein, 1052 aa, synthetic construct
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 57 - protein, 1052 aa, synthetic construct
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKKG

SEQ ID NO: 58 - protein, 1367 aa, synthetic construct; identical to SEQ ID NO: 36

SEQ ID NO: 59 - protein, 1367 aa, synthetic construct; identical to SEQ ID NO: 35

SEQ ID NO: 60 - protein, 1367 aa, synthetic construct
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFESPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 61 - protein, 1367 aa, synthetic construct
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 62 - protein, 1367 aa, synthetic construct
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 63 - protein, 1367 aa, synthetic construct
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTAFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGALSRKLINGIRDKQSGKTILDFLKSDGFANRNFMALIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRAITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 64 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 65 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMNHRVEITEGILADECAALLSDFFRMRRQEIKAQKKAQSSTD

SEQ ID NO: 66 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARGAKTGAAGSLMDVLHHPGMNHRVEITEGILADECAALLSDFFRMRRQEIKAQKKAQSSTD

SEQ ID NO: 67 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARVAKTGAAGSLMDVLHHPGMNHRVEITEGILADECAALLSDFFRMRRQEIKAQKKAQSSTD

SEQ ID NO: 68 - protein, 166 aa, synthetic construct
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQEIKAQKKAQSSTD

SEQ ID NO: 69 - protein, 166 aa, synthetic construct
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQDIKAQKKAQSSTD

SEQ ID NO: 70 - protein, 166 aa, synthetic construct
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQGIKAQKKAQSSTD

SEQ ID NO: 71 - protein, 166 aa, synthetic construct
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARNAKTGAAGSLMDVLHHPGMSHRVEITEGILADECAALLSDFFRMRRQVIKAQKKAQSSTD

SEQ ID NO: 72 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 73 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECAALLSYFFRMRRQVFKAQKKAQSSTD

SEQ ID NO: 74 - protein, 166 aa, synthetic construct
AEVEFSHEYWMRHALTLAKRAWDEREVPVGAVLVHNNRVIGEGWNRPFGRHDPTAHAEIMALRQGGLVMQNYRLIDATLYVTLEPCVMCAGAMIHSRIGRVVFGVRNAKTGAAGSLMDVLHHPGMNHRVEITEGILADECAALLSYFFRMRRQVIKAQKKAQSSTD

SEQ ID NO: 75 - protein, 166 aa, synthetic construct
SEVEFSYEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGTRNAKTGAAGSLMDVLHHPGMSHRVEITEGILADECAALLSDFFRMRRQEIKAQSKAQSSTD

SEQ ID NO: 76 - protein, 166 aa, synthetic construct
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 77 - protein, 166 aa, synthetic construct
SEVEFSHEYWMRHALTLAKRAWDGGEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNDLLSYFFRMRRQVFKAQKKAQSSTD

SEQ ID NO: 78 - protein, 166 aa, synthetic construct
SEVEFSHEYWMRHALTLAKRAWDDGEVPVGAVLVHNNRVIGEGWNRPIGRHDPTAHAEIMALRQGGLVMQNYRLIDATLYVTFEPCVMCAGAMIHSRIGRVVFGVKNAKTGAAGSLMDVLHYPGMNHRVEITEGILADECNGLLSYFFRMRRQVFKAQKKAQSSTD

SEQ ID NO: 79 - protein, 166 aa, synthetic construct
SEVEFSHEYWMRHALTLAKRAWDEQEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 80 - protein, 166 aa, synthetic construct
SEVEFSHEYWMRHALTLAKRAWDMGEVPVGAVLVHNNRVIGEGWNRPIGRHDPTAHAEIMALRQGGLVMQNYRLIDATLYVTFEPCVMCAGAMIHSRIGRVVFGVPNAKTGAAGSLMDVLHYPGMNHRVEITEGILADECNDLLSYFFRMRRQVFKAQKKAQSSTD

SEQ ID NO: 81 - protein, 166 aa, synthetic construct
SEVEFSHEYWMRHALTLAKRAWDECEVPVGAVLVHNNRVIGEGWNRPIGRHDPTAHAEIMALRQGGLVMQNYRLIDATLYVTFEPCVMCAGAMIHSRIGRVVFGVHNAKTGAAGSLMDVLHYPGMNHRVEITEGILADECNALLSYFFRMRRQVFKAQKKAQSSTD

SEQ ID NO: 82 - protein, 166 aa, synthetic construct
SEVEFSHEYWMRHALTLAKRAWDEREVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNLLLSYFFRMRRQVFKAQKKAQSSTD

SEQ ID NO: 83 - protein, 166 aa, synthetic construct
SEVEFSHEYWMRHALTLAKRAWDEGEVPVGAVLVHNNRVIGEGWNRPIGRHDPTAHAEIMALRQGGLVMQNYRLIDATLYVTFEPCVMCAGAMIHSRIGRVVFGVRNAKTGAAGSLMDVLHYPGMNHRVEITEGILADECNALLSYFFRMRRQVFKAQKKAQSSTD

SEQ ID NO: 84 - protein, 178 aa, Escherichia coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 85 - DNA, 23 bp, synthetic construct
  source 1..23: mol_type = other DNA
tatatgcatatttattacatcgg

SEQ ID NO: 86 - DNA, 23 bp, synthetic construct
  source 1..23: mol_type = other DNA
ccgtcatgtgggtcctgaattgg

SEQ ID NO: 87 - DNA, 23 bp, synthetic construct
  source 1..23: mol_type = other DNA
acactgaaagactccaggtcagg

SEQ ID NO: 88 - DNA, 23 bp, synthetic construct
  source 1..23: mol_type = other DNA
gtcagaagagatgtggtcaatgg

SEQ ID NO: 89 - DNA, 23 bp, synthetic construct
  source 1..23: mol_type = other DNA
tttaaagtgaagcagcatctggg

SEQ ID NO: 90 - DNA, 23 bp, synthetic construct
  source 1..23: mol_type = other DNA
atttaaagtgaagcagcatctgg

SEQ ID NO: 91 - DNA, 23 bp, synthetic construct
  source 1..23: mol_type = other DNA
actccatgacagtgtaattttgg

SEQ ID NO: 92 - DNA, 23 bp, synthetic construct
  source 1..23: mol_type = other DNA
gcctggagaagccatccagcagg

SEQ ID NO: 93 - DNA, 23 bp, synthetic construct
  source 1..23: mol_type = other DNA
ctcagacacactcattgatgagg

SEQ ID NO: 94 - DNA, 24 bp, synthetic construct
  source 1..24: mol_type = other DNA
gaggcactgcccccaccatgagcg

SEQ ID NO: 95 - DNA, 85 bp, synthetic construct
  source 1..85: mol_type = other DNA
tcataagcattctgccgacatggaagccgtcgcatacggtgtggtgcacctggatggccagcggcatcagcaccttgtcgccttg

SEQ ID NO: 96 - protein, 29 aa, synthetic construct
ENLMRGVHFGDCVTHHVQIALPMLVKDGQ

SEQ ID NO: 97 - DNA, 86 bp, synthetic construct
  source 1..86: mol_type = other DNA
tcattaagcattctgccgacatggaagccgtcgcatacggcgcggtgcacctggatggccagcggcatcagcaccttgtcgccttg

SEQ ID NO: 98 - protein, 29 aa, synthetic construct
ENLMRGVHFGDCVARHVQIALPMLVKDGQ

SEQ ID NO: 99 - DNA, 59 bp, synthetic construct
  source 1..59: mol_type = other DNA
ccgtcgcatacggtgtggtgcacctggatggccagcggcatcagcaccttgtcgccttg

SEQ ID NO: 100 - DNA, 96 bp, synthetic construct
  source 1..96: mol_type = other DNA
caaatattatacgcaaggcgacaaggtgctgatgccgctggccatccaggtgcaccacgccgtatgcgacggcttccatgtcggcagaatgcttaa

SEQ ID NO: 101 - protein, 32 aa, synthetic construct
KYYTQGDKVLMPLAIQVHHAVCDGFHVGRMLN

SEQ ID NO: 102 - DNA, 96 bp, synthetic construct
  source 1..96: mol_type = other DNA
caaatattatacgcaaggcgacaaggtgctgatgccgctggccatccaggtgcactacgccgtatgcgacggcttccatgtcggcagaatgcttaa

SEQ ID NO: 103 - protein, 32 aa, synthetic construct
KYYTQGDKVLMPLAIQVHYAVCDGFHVGRMLN

SEQ ID NO: 104 - DNA, 86 bp, synthetic construct
  source 1..86: mol_type = other DNA
caaatattatacgcaaggcgacaaggtgctgatgccgctggccatccaggtgcaccacgccgtatgcgacggctccagtcgccaaa

SEQ ID NO: 105 - protein, 84 aa, synthetic construct
XXXRLXXXTLYVTLEPCVMCAGXXXXSRIXRVVXGAXDXKXGXXGSLMBXLXXXXXNHRXXXXXGXLXXXCXXLLXXFFXXXRX

SEQ ID NO: 106 - protein, 84 aa, synthetic construct
QNYRLIDATLYVTLEPCVMCAGAMIHSRIGRVVFGARDAKTGAAGSLMDVLHHPGMNHRVEITEGILADECAALLSDFFRMRRQ

SEQ ID NO: 107 - protein, 84 aa, synthetic construct
GSWRLEGCTLYVTLEPCVMCAGTIVMSRIPRVVYGADDPKGGCSGSLMNLLQQSNFNHRAIVDKGVLKEACSTLLTTFFKNLRA

SEQ ID NO: 108 - protein, 1359 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 109 - protein, 1355 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFANEIAKVDESFFQRLDESFLTDDDKTFDSHPIFGNKAEEDAYHQKFPTIYHLRKHLADSSEKADLRLVYLALAHMIKFRGHFLIEGELNAENTDVQKIFADFVGVYNRTFDDSHLSEITVDVASILTEKISKSRRLENLIKYYPTEKKNTLFGNLIALALGLQPNFKTNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNILSKIKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGGNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKLGEE

SEQ ID NO: 110 - protein, 1359 aa, Streptococcus mitis
KKGYSIGLDIGTNSVGFAVITDDYKVPSKKMKVLGNTDKRFIKKNLIGALLFDEGTTAEARRLKRTARRRYTRRKNRLRYLQEIFSEEMSKVDSSFFHRLDDSFLIPEDKRESKYPIFATLTEEKEYHKQFPTIYHLRKQLADSKEKTDLRLIYLALAHMIKYRGHFLYEEAFDIKNNDIQKIFNEFISIYDNTFEGSSLSGQNAQVEAIFTDKISKSAKRERVLKLFPDEKSTGLFSEFLKLIVGNQADFKKHFDLEDKAPLQFSKDTYDEDLENLLGQIGDDFTDLFVSAKKLYDAILLSGILTVTDPSTKAPLSASMIERYENHQNDLAALKQFIKNNLPEKYDEVFSDQSKDGYAGYIDGKTTQETFYKYIKNLLSKFEGTDYFLDKIEREDFLRKQRTFDNGSIPHQIHLQEMNAILRRQGEYYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVNQLFKENRKVTEKDIIHYLHNVDGYDGIELKGIEKQFNASLSTYHDLLKIIKDKEFMDDAKNEAILENIVHTLTIFEDREMIKQRLAQYDSLFDEKVIKALTRRHYTGWGKLSAKLINGICDKQTGNTILDYLIDDGKINRNFMQLINDDGLSFKEIIQKAQVIGKTDDVKQVVQELSGSPAIKKGILQSIKIVDELVKVMGHAPESIVIEMARENQTTARGKKNSQQRYKRIEDSLKILASNILKENPTDNNQLQNDRLFLYYLQNGKDMYTGEALDINQLSSYDIDHIIPQAFIKDDSLDNRVLTSSKDNRGKSDNVPSIEVVQKRKAFWQQLLDSKLISERKFNNLTKAERGGLDERDKVGFIKRQLVETRQITKHVAQILDARYNTEVNEKDKKNRTVKIITLKSNLVSNFRKEFRLYKVREINDYHHAHDAYLNAVVAKAILKKYPKLEPEFVYGEYQKYDLSKDPKEVEKATEKYFFYSNLLNFFKEEVHYADGTIVKRENIEYSKDTGEIAWNKEKDFAIIKKVLSLPQVNIVKKREVQTGGFSKESILPKGNSDKLIPRKTKDILLDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPGHLEYIQKHRNEFKDLLNLVSEFSQKYVLADANLEKIKSLYADNEQADIEILANSFINLLTFTALGAPAAFKFFGKDIDRKRYTTVSEILNATLIHQSITGLYETWIDLSKLGED

SEQ ID NO: 111 - protein, 986 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGNPYEARVKGLSQKLSEEEFSAALLHLAKRRGVHNVNEVEEDTGNELSTKEQISRNSKLEEKYVAELQLERLKKDGEVRGSINRKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKENAELLDQIAKILTIYQSSEDIQEELTNLNSELTQEEIEQISNLKGYTGTHNLSLKAINLILDELWTNDNQIAIFNRLKLVPKKVDLSQQKEIPTTLVDDFILSPVVKRSFIQSIKVINAIIKKYGLPNDIIIELAREKNSKDAQKMINEMQKQTNEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDQKDFINRNLVDTRYATRGLMNLLRSYFRVNNLDVKVKSINGGFTSFLRRKWKFKKERNKGYKHHAEDALIIANADFIFKEWKKLDKNQMFEEKETEQEYKEIFITPHQIKHIKDFKDYKYSHRVDKKPNREVNNLNGLYDKDNDKLKKLINKSPEKLLMYHHDPQTYQKKLIMEQYGDEKNLYKYYEETGNYLTKYSKKDNGPVIKKIKYYGNKLNAHLDITDDYPNSVKLSLKPYRFDVYLDNGVYKFVTVKNLDVIKKENYYEVNSKAYEEAKKKKISNQAEFIASFYNNDLIKINGELYRVIGVNNDLLNRIEVNMIDITYREYLENMNDKRPPRIIKTIASKTQSIKKLYEVKSKKHPQIIKKG

SEQ ID NO: 112 - protein, 1044 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 113 - protein, 1359 aa, Streptococcus pyogenes; identical to SEQ ID NO: 108

SEQ ID NO: 114 - protein, 1359 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 115 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 116 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 117 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 118 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 119 - protein, 1358 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 120 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 121 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 122 - protein, 1358 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 123 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKASLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 124 - protein, 1359 aa, Streptococcus pyogenes
MDKKYSIGLDIGTNSVGWAVITDDYKVPSKKFKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 125 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFIKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNFGAPAAFIYFDTTIGRNRYKSIKEVLDATLIHQSITGLYETRIDLSQLGGD

SEQ ID NO: 126 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 127 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGGLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDISEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 128 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINANGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 129 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALLLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKKYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 130 - protein, 1359 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNRKDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 131 - protein, 1184 aa, Streptococcus pyogenes
PDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 132 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 133 - protein, 1358 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENINASRVDAKAILSARLSKSRRLENLIAQLPGEKKNGLFGNLIALSLGLTPNFKSNFDLAEDTKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYETRIDLSQLGGD

SEQ ID NO: 134 - protein, 1359 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKIVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIGRNRYKSIKEVLDATLIHQSITGLYETRIDLSQLGGD

SEQ ID NO: 135 - protein, 1270 aa, Streptococcus pyogenes
MAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 136 - protein, 536 aa, Streptococcus pyogenes
QELDINRLSGYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 137 - protein, 305 aa, Streptococcus pyogenes
IETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 138 - protein, 1359 aa, synthetic construct
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 139 - protein, 1341 aa, synthetic construct
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 140 - protein, 1356 aa, synthetic construct
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDISSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 141 - protein, 1365 aa, Streptococcus agalactiae
MNKPYSIGLDIGTNSVGWSIITDDYKVPAKKIRVLGNTDKEYIKKNLIGALLFDGGNTAADRRLKRTARRRYTRRRNRILYLQEIFAEEMSKVDDSFFHRLEDSFLVEEDKRGSKYPIFATLQEEKYYHEKFPTIYHLRKELADKKEKADLRLVYLALAHIIKFRGHFLIEDDRFDVRNTDIQKQYQAFLEIFDTTFENNDLLSQDVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIVADSSKDGYAGYIEGKTNQEAFYKYLSKLLTKQEGSEYFLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVIGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFVFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDIFQIINDFSKRVILADANLEKINRLYQDNKENIPVDELANNIINLFTFTSLGAPAAFKFFDKIVDRKRYTSTKEVLNSTLIHQSITGLYETRIDLGKLGED

SEQ ID NO: 142 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKQEKADLRLIYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGLYRRKKLSKIVRATRKMFFYSNLMNMFKRVVRLADGSIVVRPVIETGRYMGKTAWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSKFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLSKLGED

SEQ ID NO: 143 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNITFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 144 - protein, 1369 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTIFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGETIDRLQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 145 - protein, 1363 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIIQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 146 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDDLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 147 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 148 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 149 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 150 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVVGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 151 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLRQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 152 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 153 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQHYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 154 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWERLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 155 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHLDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEVQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQYMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 156 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 157 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 158 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPKVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 159 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPLLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLDIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 160 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 161 - protein, 1365 aa, Streptococcus agalactiae
MNKPYSIGLDIGTNSVGWSIITDDYKVPAKKMRVLGNTDKEYIKKNLIGALLFDGGNTAADRRLKRTSRRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 162 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTCRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 163 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 164 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGETLDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEREFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 165 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQFITGLYETRIDLGKLGED

SEQ ID NO: 166 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 167 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 168 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSEKKPKYVKDQVENHHLSDDRLFLYYLQNGKDMYTDDELDIDNLSQYDIDLIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 169 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDIEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 170 - protein, 1365 aa, Streptococcus agalactiae
MNKPYSIGLDIGTNSVGWSIITDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLFYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLIDDGKSNRNFMQLIHDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 171 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFPTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 172 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTALSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 173 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVAADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 174 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKASLSDSMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 175 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVEIRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 176 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTVKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 177 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDELFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGGD

SEQ ID NO: 178 - protein, 1365 aa, Streptococcus agalactiae; identical to SEQ ID NO: 147

SEQ ID NO: 179 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNKGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 180 - protein, 1365 aa, Streptococcus agalactiae
MNKPYSIGLDIGTNSVGWSIITDDYKVPAKKMRVLGNTDKEYIKKNLIGALLFDGRNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 181 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDSFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLANLKSEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHKSITGLYETRIDLGKLGED

SEQ ID NO: 182 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVIKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 183 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVASILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 184 - protein, 1365 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIESKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 185 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNLSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIIDRKRYTSTKEVLNSTLIHQSITGLYETRIDLGKLGED

SEQ ID NO: 186 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKDIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 187 - protein, 1365 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKIILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDILKEYPTDNQALQNERLFLYYLQNGRDMYTGEALDIDSLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 188 - protein, 1365 aa, Streptococcus agalactiae
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 189 - protein, 1365 aa, Streptococcus agalactiae
MNKPYSIGLDIGTNSVGWSIITDDYKVPAKKMRVLGNTDKEYIKKNLIGALLFDGGNTAADRRLKRIARRRYTRRRNRILYLQEIFAEKMSKVDDSFFHRLEDSFLVEEDKRGSKYPIFATLQEEKDYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPDQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEELVDKEASAEAFIHCMTNNDLYLPEEKVLPKHSLIYEKFTVYNELTKVRYKNEQGETYFFDSNIKQEIFDGVFKEYRKVSKKQLLDFLAKEFEEFRIVDVTGLDKENKAFNASLGTYHDLEKILGKDFLDNPDNESILEDIVQTLTLFEDREMIKKRLDIYKDFFTESQLKKLYRRHYTGWGRLSAKLINGIRNKENQKTILDYLIDDGSANRNFMQLIKDAGLSFKSIISKAQSGSHSDNLKEVVSELAGSPAIKKGILQSLKIVDELVKVMGYKPEQIVVEMARENQTTNQGRRNSRQRYKLLDDGVRNLASNILKEYPTDNQALQNERLFLYYLQNGRDMYTEKALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRTDKLIILPKYSLFELENGRRRLLASAGELQKGNELALPTQFMKFLYLASRYNESKGKPEEIEKKQEFVNQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 190 - protein, 1351 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVSDKEIGKATAKYFFYSNLMNFFKKEVKFADGTVVERPDIETSEDGEIAWNKQTDFKIVRKVLSYPQVNIVKKTEVQTHGLDRPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASRGEIHKGNELFVPQKFTTLLYHAKRINNPINKDHIEYVKKHRDDFKELLNYVLEFNEKYVGATKNGERLKEAVADFDSKSNEEICTSFLGLFELTSLGSASDFEFLGVKIPRYRDYTPSSLLKDSTLIHQSITGLYETRIDLSKLGED

SEQ ID NO: 191 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRKNRLRYLQEIFTEEMNKVDENFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQPNFKTNFQLSEDAKLQFSKDTYEEDLEELLGEIGDEYADLFASAKNLYDAILLSGILAVDDNTTKAPLSASMVKRYEEHQKDLKKLKDFIKVNAPDQYNAIFKDKNKKGYAGYIESGVEQDEFYKYLKGILLKINGSGDFLDKIDCEDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKNPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 192 - protein, 1341 aa, Streptococcus anginosus
MKKEYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVEEDKRGSRYPIFGNIAAEVKYHDDFPTIYHLRKHLVDISQKADLRLVYLALAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYEEHQKDLKKLKDFIKVNAPAQYDDIFKDETKNGYAGYIENGVKQDEFYKYLKNTLSKIDGSDYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGAQRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 193 - protein, 1341 aa, Streptococcus anginosus; identical to SEQ ID NO: 191

SEQ ID NO: 194 - protein, 1360 aa, Streptococcus caballi
MTKKNYSIGLDIGTNSVGWAVITDDYKVPAKKMKVLGNTDKKYIKKNLLGALLFDSGETAEATRLKRTARRRYTRRKNRLRYLQDIFTEEMAKVDDSFFQRLDESFLTDNDKNFDSHPIFGNKAEEDAYHQKFPTIYHLRKHLADSTEKADLRLVYLALAHMIKFRGHFLIEGELNAENTDVQKLFTDFVGVYDRTFDDSHLSEITVDAASILTEKISKSRRLENLINNYPKEKKNTLFGNLIALALGLQPNFKTNFKLSEDAKLQFSKDTYEEDLEELLGKIGDDYADLFTSSKNLYDAILLSGILTVDDNSTKAPLSASMIKRYVEHHEDLEKLKEFIKANKSELYHDIFKDKTQNGYAGYIENGVKQDEFYKYLKGILTKINGSDYFLDKIEREDFLRKQRTFDNGSIPHQIHLQEMHAILRRQGDYYPFLKENQEEIEKILTFRIPYYVGPLARKDSRFAWAEYRSDEKITPWNFDKVIDKEKSAEKFITRMTLNDLYLPEEKVLPKHSHVYETFAVYNELTKVKYVNEQGKDSFFDSNMKQEIFDHVFKENRKVTKEKLLNYLDKEFPEYRIQDLVGLDKENKSFNASLGTYHDLKKILDKSFLDDKVNEEVIEDIIKTLTLFEDREMIQQRLQKYSDIFTKQQLKKLERRHYTGWGRLSYKLINGIRNKENNKTILDYLIDDGSANRNFMQLINDDALSFKQIIQEAQVVGDVDDIETVVHDLPGSPAIKKGILQSVKIVDELIKVMGDNPDNIVIEMARENQTTNRGRSQSQQRLKKLQNSLKPSYIEDKVENSHLQNDQLFLYYIQNGKDMYTGDELDIDHLSDYDIDHIIPQAFIKDDSIDNRVLTSSAKNRGKSDDVPSLGIVRARKAEWVRLYKSGLISKRKFDNLTKAERGGLTEADKAGFIKRQLVETRQITKHVAQILDARFNTERDENDKVIRDVKVITLKSNLVSQFRKEFKFYKVREINDYHHAHDAYLNAVVGTALLKKYPKLAPEFVYGEYKKYDVSSDDHSEMGKATAKYFFYSNLMNFFKRVIRYSNGKVIVRPVVEYSKDTGEIAWNKRTDFEKVRKVLSYPQVNIVKKVETQTGGFSKESILPKGDSDKLIPRKTKKVLWEPKKYGGFDSPTVAYSVLVVADVEKGKTKKLKTVKELVGISIMERSFFEKNPVEFLKNKGYQNVQEDKLMKLPKYSLFEFEGGRRRLLASATELQKGNEIMLSAHLVALLYHAHRIGNFNSAEHLKYVSEHKKEFEEVLSCVENFANVYVDVEKNLSKIRAAADSMDNFSIEEISDSFINLLTLTALGAPADFNFLGEKIPRKRYNSTKECLNATLIHQSITGLYETRIDLSKLGEE

SEQ ID NO: 195 - protein, 1355 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 196 - protein, 1341 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 197 - protein, 1355 aa, Streptococcus constellatus
MTQKYSIGLDIGTNSVGWAIVTDDYKVPAKKMKILGNTNKQYIKKNLLGALLFDSGETAKATRLKRTARRRYTRRKNRLRYLQEIFIEEMNKVDENFFQRLDDSFLVTEDKRGSKYPIFGTLKEEKEYYKEFETIYHLRKRLADSTGKVDLRLVYLALAHMIKFRGHFLIEGQLKAENTDVQTLFNDFVEVYDKTIEESHLAEITVDALSILTEKVSKSRRLENLVKCYPTEKKNTLFGNLIALSLGLQPNFKTNFQLSEDAKLQFSKDTYEEDLEELLGKIGDDYADLFTSAKNLYDTILLSGILAVDDNSTKALLSASMIKRYEEHQKDLKKLKDFIKVNAPAQYDDIFKDETKNGYAGYIENGVKQDEFYKYLKNTLSKIDGSGYFLDKIEREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYEIFTVYNELTKVKYVNEQGEAKFFDANMKQEIFDHVFKENPKVTKDKLLNYLDKEFDEFRIVDLTGLDKENKAFNASLGTYHDLRKILDKSFLDDKANEKTIEDIIQTLTLFEDREMIRQRLQKYSDIFTKAQLKKLERRHYTGWGRLSYKLINGIRNKENNKTILEYLVDDGYANRNFMQLINDDTLPFKQIIKDAQAIDDVDDIELIVHDLPGSPAIKKGILQSIKIVDELVKVMGYNPDNIVIEMARENQTTTKGRRNSQQRLKLLQDSLTPVSIKNVENQQLQNDRLFLYYIQNGKDMYTGEELDIHHLSDYDIDHIIPQAFIKDDSIDNRVLTSSAKNRGKSDNVPNLEVVCDRKADWIRLREAGLISQRKFDNLTKAERGGLTENDKAGFIHRQLVETRQITKHVAQILDARFNPKRDDNKKVIRDVKIITLKSNLVSQFRRDFKLYKVREINDYHHAHDAYLNAVVGTALLKKYPKLTSEFVYGEYKKYDVSDNDEIGKATAKYFFYSNLMNFFKTEVKFADGTVVERPDIETSEDGEIAWNKQTDFKIVRKVLSYPQVNIVKKVEKQTGRFSKESILPKGDSDKLIARKTKENYWDTKKYGGFDSPTVAYSVLVVADIKKGKAKKLKTVKELVGISIMERPFFEKNPIMFLESKGYRNIQKDKLIKLPKYSLFEFEGGRRRLLASAVELQKGNEMVLPQYLNNLLYHAHRIDNSDNSEHLKYITEHKEEFGKLLSYIENFAKSYVDVDKNLEKIQLAVEKIDSFSVKEISNSFIHLLTLTALGAPADFNFLGEKIPRKRYTSTKECLNATLIHQSITGLYETQTDLSKLGED

SEQ ID NO: 198 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 199 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 200 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 201 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 202 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKCKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 203 - protein, 1356 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 204 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASSELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 205 - protein, 1345 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLASSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPINERAENIINVFTFVALGAPAAFKFFDATIDRKRYTSTKEVLNATLIHQSVTGLYETRIDLSQLGEN

SEQ ID NO: 206 - protein, 1345 aa, Streptococcus equi
MKKPYTIALDIGTNSVGWVVVTDDYRVPTKKMKVLGNTERKTIKKNLIGALLFDSGDTAEGTRLKRTARPRYTRRKNRLRFLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKDGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQLQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKTLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERIAFEENPVVFLEAKGYREIQEHLIIKLPKYSLFELENGRRRLLASSELQKGNELFLPVDYMTFLYLAAHYHELTGSSEDVLRKKYFVERHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 207 - protein, 1360 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 208 - protein, 1353 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDISSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 209 - protein, 1354 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDISGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 210 - protein, 1355 aa, Streptococcus gallolyticus; identical to SEQ ID NO: 109

SEQ ID NO: 211 - protein, 1358 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 212 - protein, 1358 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 213 - protein, 1263 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFXEVKSSF

SEQ ID NO: 214 - protein, 1257 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYXFX

SEQ ID NO: 215 - protein, 199 aa, Streptococcus iniae
MEQDEFEKDPIAFLEKKGYQDIQTSSIIKLPKYSLFELENGRKRLLASKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 216 - protein, 1271 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASELQKGNELALPNKYVKFLYLASHYTKFTGKEEDREKKRSYVESHLYYFDVRLSQVFRVTNVEF

SEQ ID NO: 217 - protein, 1345 aa, Streptococcus intermedius
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIEDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYIGPLARGKSDFSWLSRKSADKITPWNFDEIVDKESSAEAFINRMTNYDLYLPNQKVLPRHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKNLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIANIEKGKSKKLKLVKDLVGITIMERTIFEKNPVAFLERKGYRNVQEENIVKLPKYSLFELENGRRRLLASARELQKGNEIVLPNHLGTMLYHAKNIHKVDEPKHLDYVKKHKDEFKELLDVVSNFSKKNILAESNLEKIEELYAQNNNKDITELASSFINLLTFTAIGAPAAFKFFDNNIDRKRYTSTTEILNATLIHQSITGLYETRIDLSRLGGD

SEQ ID NO: 218 - protein, 1333 aa, Streptococcus massiliensis
MKKPYSIGLDIGTNSVGWAVVMEDYKVPSKKMKVLGNTDKQSIKKNLIGALLFDSGETAVERRLNRTTSRRYDRRRNRIRYLQHIFAEEMNRADENFFHRLKESFFVEEDKTYSKYPIFGTLEEEKNYHKNYPTIYHLRKTLADTPDKMDIRLIYLALAHIIKYRGHFLIEGDLDIENIGIQDSFKSFIEEYNTQFGTKLDSTTKVEAIFTENSSKAKRVETILGLFPDETAAGNLDKFLKLMLGNQADFKKVFDLEEKITLQFSKDSYEEDLELLLSKIDEEYAALFDLAKKVYDAVLLSNILTVKEKNTKAPLSASMIKRYEEHKDDLKAFKRFFRERLPEKYETMFKDLTKPSYAAYVSGAVTEDDFYKFSKGLLIDVEGAEYFLEKIEREDFLRKQRTFDNGAIPNQVHVKELQAIILNQSKYYPFLAENKEKIEKILTFRIPYYVGPLARGNSSFAWLQRKSDEAIRPWNFEQVVDMETSASRFIERMTLHDLYLPDEKVLPRHSLIYEKYTVFNELTKVRFTPEGGKEVYFSKTDKENIFDSLFKRYRKVTKRKLKDFIEKELGYGYIDIDNIKGVEEQFNASYTTYQDLLKIIGDKEFLDNEENKDLLEEIIYILTVFEDRKMIEKRLSELNIPFENKIIKKLARKKYTGWGNLSRKLIDGIRNRETNRTILGHLIDDGFSNRNLMQLINDDGLDFKEIIRKAQTIENIDTNQALVSSLPGSPAIKKGILQSLNIVDEIIAIMGYAPTNIVIEMARENQTTQKGRDNSAQRLKKIEDGIKLGSDLLKQNPIQDNKDLQKEKLFLYYMQNGIDLYTGQPLNCDPDSLAFYDVDHIVPRSYIKNDSFDNKVLTTSKGNRKKLDDVPAKEVVEKMENTWRRLHAAGLISDIKLSYLMKGELTEEDKAGFIRRQLVETRQITKHVARLLDEKLNRKKNENGEKLRTTKIITLKSVFASRFRANFDLYKLRELNHYHHAHDAYLNAVVAQALLKVYPKFERELVYGSYVKESIFSRKATERMRMYNNILKFISKDKKDQETGEIVWDKKEIENIVKKVIYSSPVNIVKKREEQSGALFKQSNMAVGYNNKLIPRKKDWSVDKYGGFIEPAESYSLAIFYTDINGKKPKKKSTIIAISRMEKKDYEKEPERFLAQKGFERVEKTIKLPKYSLFEMEKGRRRLLASSGELQKGNQVLLPEHLIRLLSYAKKVDVLVKSKDDDYDLEEHRAEFAELLDCIKKFNDMYILASSNMSKIEEIYQKNIDAPIEEVARSFVLLNFTMMGAATDFKFFGQIIPRKRYPSTTECLKSTLIHQSVTGLYETRIDLSKLGEN

SEQ ID NO: 219 - protein, 1361 aa, Streptococcus mitis
NNKPYSIGLDIGTNSVGWAVITDDYKVPSKKMKVLGNTDKHFIKKNLLGALLFDEGTTAEDRRLKRTARRRYTRRKNRLRYLQEIFTEEMSKVDISFFHRLDDSFLVPEDKRGSKYPIFATLEEEKEYHKNFPTIYHLRKHLADSKEKADFRLIYLALAHIIKYRGHFLYEESFDIKNNDIQKIFNEFISIYDNTFEGSSLNGQNAQVEAIFTDKISKSAKRERVLKLFPDEKSTGLFSEFLKLIVGNQADFKKHFDLEEKAPLQFSKDTYDEDLENLLVQIGDDFADLFLVAKKLYDAILLSGILTVTDPSTKAPLSASMIDRYENHQKDLAALKQFIKTNLPEKYDEVFSDQSKDGYAGYIDGKTTQEAFYKYIKNLLSKLEGADYFLDKIEREDFLRKQRTFDNGSIPHQIHLQEMNAIIRRQGEHYPFLQENKEKIEKILTFRIPYYVGPLARGNRDFAWLTRNSDQAIRPWNFEEIVDKARSAEDFINKMTNYDLYLPEEKVLPKHSLLYETFAVYNELTKVKFIAEGLRDYQFLDSGQKQQIVTQLFKEKRKVTEKDIIQYLHNVDSYDGIELKGIEKQFNASLSTYHDLLKIIKDKEFMDDSKNEAILENIVHTLTIFEDREMIKQRLAHYASIFDEKVIKALTRRHYTGWGKLSAKLINGIYDKQSKKTILDYLIDDGEINRNFMQLINDDGLSFKEIIQKAQVVGKTNDVKQVVQELPGSPAIKKGILQSIKLVDELVKVMGHAPESIVIEMARENQTTARGKKNSQQRYKRIEDALKNLAHNILKEHPTDNIQLQNDRLFLYYLQNGKDMYTGKSLDINQLSSCDIDHIIPQAFIKDDSLDNRVLTSSKDNRGKSDNVPSLEIVQKRKAFWQQLLDSKLISERKFNNLTKAERGGLDERDKVGFIKRQLVETRQITKHVAQILDARFNTEVTEKDKKDRSVKIITLKSNLVSNFRKEFRLYKVREINDYHHAHDPYLNAVVAKAILKKYPKLEPEFVYGDYQKYDLTKDPKEVEKATEKYFFYSNLLNFFKEEVHYADGTIVKRENIEYSKDTGEIAWNKEKDFATIKKVLSLPQVNIVKKTEEQTGGLFDNNIVSKKKVVDASKLTPIKSGLSPEKYGGYARPTIAYSVLVIADIEKGKAKKLKRIKEMVGITVQDKKKFEANPIAYLEECGYKNINPNLIIKLPKYSLFEFNNGQRRLLASSIELQKGNELIVPYHFTALLYHAQRINKISEPIHKQYVETHQSEFKELLTAIISLSKKYIQKPNVESLLQQAFDQSDKDIYQLSESFISLLKLISFGAPGTFKFLGVEISQSNVRYQSVSSCFNATLIHQSITGLYETRIDLSKLGED

SEQ ID NO: 220 - protein, 1359 aa, Streptococcus mitis; identical to SEQ ID NO: 110

SEQ ID NO: 221 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 222 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 223 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 224 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 225 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 226 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 227 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 228 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 229 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 230 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 231 - protein, 1336 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLNKLGGD

SEQ ID NO: 232 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 233 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 234 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 235 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 236 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 237 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 238 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 239 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 240 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 241 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 242 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 243 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 244 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 245 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 246 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 247 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 248 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 249 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKHQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 250 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGQRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPDHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 251 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 252 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 253 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 254 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIIGNQADFKKHFELEEKAPLQFSKDTYEEELEVLLAQIGDNYAELFLSAKKLYDSILLSGILTVTDVGTQAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 255 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 256 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGECHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGNGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 257 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKVPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 258 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQNLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 259 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKSKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 260 - protein, 1336 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYLKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLEATLIHQSITGLYETRIDLSKLGGD

SEQ ID NO: 261 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLVQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 262 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 263 - protein, 1336 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMNKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKATQKMFFYSNIMNMFKSKVKLADDQIVERPMIEVNDETGEIAWDKTKHITTVKKVLSYPQVNIVKKVEEQTGGLFDPKSPLEKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLEATLIHQSITGLYETRIDLSKLGGD

SEQ ID NO: 264 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYYENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 265 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILKATLIHQSITGLYETRIDLSKLGGD

SEQ ID NO: 266 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 267 - protein, 1362 aa, Streptococcus oralis
ENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 268 - protein, 1360 aa, Streptococcus oralis
ENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 269 - protein, 1358 aa, Streptococcus parasanguinis
KKPYSIGLDIGTNSVGWAVITDDYKVPAKKMKVLGNTNKESIKKNLIGALLFDAGNTAADRRLKRTARRRYTRRRNRILYLQEIFAAEMNKVDESFFHRLDDSFLVPEDKRGSKYPIFGTLEEEKEYHKQFPTIYYLRKILADSKEKVDLRLIYLALAHIIKYRGHFLYEDSFDIKNNDIQKIFNEFTILYDNTFEESSLSKGNAQVEEIFTDKISKSAKRDRVLKLFPDEKSTGLFSEFLKLIVGNQADFKKHFDLEEKAPLQFSKDTYEEDLESLLGQIGDVYADLFVVAKKLYDAILLAGILSVKDPGTKAPLSASMIERYDNHQNDLSALKQFVRRNLPEKYAEVFSDDSKDGYAGYIDGKTTQEGFYKYIKNLISKIEGAEYFLEKIEREDFLRKQRTFDNGSIPHQIHLQEMNAILRHQGEYYPFLKENKDKIEQILTFRIPYYVGPLARGNSDFAWLSRNSDEAIRPWNFEEMVDKSSSAEDFIHRMTNYDLYLPEEKVLPKHSLLYETFTVYNELTKVKYIAEGMKDYQFLDSGQKKQIVNQLFKEKRKVTEKDIIHYLHNVDGYDGIELKGIEKHFNSSLSTYHDLLKIIKDKEFMDDPKNEEIFENIVHTLTIFEDRVMIKQRLNQYDSIFDEKVIKALTRRHYTGWGKLSAKLINGIRDKKTSKTILDYLIDDGYSNRNFMQLINDDGLSFKETIQKAQVVGETNDVKQVVQELPGSPAIKKGILQSIKIVDELVKVMGHAPESVVIEMARENQTTNKGKSKSQQRLKTLSDAISELGNILKEHPTDNIQLQNDRLFLYYLQNGKDMYTGEALDINQLSNYDIDHIIPQAFIKDDSLDNRVLTSSKDNRGKSDNVPSLEIVEKMKGFWQQLLDSKLISERKFNNLTKAERGGLDERDKVGFIKRQLVETRQITKHVAQILDDRFNAEVNEKNQKLRSVKIITLKSNLVSNFRKEFGLYKVREINDYHHAHDAYLNAVVAKAILKKYPKLEPEFVYGDYQKYDLTKDPKEIEKATEKYFFYSNLLNFFKDKVYYADGTIIQRGNVEYSKDTGEIAWNKKRDFAIVRKVLSYPQVNIVKKTEEQTGGFSKESILPKGNSDKLIPRKTKNVQLDTTKYGGFDSPVIAYSILLVADVEKGKSKKLKTVKSLIGITIMEKVKFEANPVAFLEGKGYQNVVEENIIRLPKYSLFELENGRRRMLASAKELQKGNEMVLPSYLIALLYHAKRIQKKDEPEHLEYIKQHHSEFNDLLNFVSEFSQKYVLAESNLEKIKNLYIDNEQTNMEEIANSFINLLTFTAFGAPAVFKFFGKDIERKRYSTVTEILKATLIHQSLTGLYETRIDLSKLGEE

(The sequence listing continues in the following parts.)

What is claimed is:

1. An adenosine deaminase comprising an amino acid sequence having at least 85% amino acid sequence identity to the amino acid sequence of SEQ ID NO: 1, with the exception of one or more of the following substitutions H36L, P48A, L84F, A106V, D108N, S146C, S146R, R152P, E155V, I156F, and K157N in the amino acid sequence of SEQ ID NO: 1, and wherein said adenosine deaminase deaminates adenine in deoxyribonucleic acid (DNA).

2. The adenosine deaminase of claim 1, wherein said adenosine deaminase comprises an amino acid sequence having 90% amino acid sequence identity to the amino acid sequence of SEQ ID NO: 1.

3. An adenosine deaminase comprising an amino acid sequence having at least 85% amino acid sequence identity to the amino acid sequence of SEQ ID NO: 1, with the exception of the following amino acid substitutions H36L, P48A, L84F, A106V, D108N, S146C or S146R, R152P, E155V, I156F, and K157N in the amino acid sequence of SEQ ID NO: 1, and wherein said adenosine deaminase deaminates adenine in deoxyribonucleic acid (DNA).

4. An adenosine deaminase comprising an amino acid sequence having at least 85% amino acid sequence identity to the amino acid sequence of SEQ ID NO: 1, with the exception of the following amino acid substitutions H36L, P48A, L84F, A106V, D108N, S146C or S146R, R152P, E155V, I156F, and K157N, and one or more substitutions at positions selected from the group consisting of amino acid residues corresponding to positions 123, 147, 154, and 166 in the amino acid sequence of SEQ ID NO: 1, wherein said adenosine deaminase variant deaminates adenine in deoxyribonucleic acid (DNA).

5. The adenosine deaminase of claim 1, wherein said one or more substitutions comprise the following group of substitutions: H36L, P48A, L84F, A106V, D108N, S146C or S146R, R152P, E155V, I156F, and K157N in the amino acid sequence of SEQ ID NO: 1.

6. The adenosine deaminase of claim 3, wherein the adenosine deaminase further comprises one or more substitutions at positions selected from the group consisting of amino acid residues corresponding to positions 23, 25, 51, 70, 72, 94, 138, 147, and 154 in the amino acid sequence of SEQ ID NO: 1.

7. The adenosine deaminase of claim 3, wherein the adenosine deaminase further comprises one or more substitutions at positions selected from the group consisting of amino acid residues corresponding to positions 123, 147, 154, and 166 of the amino acid sequence of SEQ ID NO: 1.

8. The adenosine deaminase of claim 3, wherein the adenosine deaminase further comprises the substitution Q154R in the amino acid sequence of SEQ ID NO: 1.

9. A base editor comprising:
a nucleic acid programmable DNA binding protein (napDNAbp) domain, wherein said napDNAbp domain when in conjunction with a bound nucleic acid, site specifically binds a nucleic acid sequence; and
an adenosine deaminase domain comprising the adenosine deaminase of claim 1.

10. The base editor of claim 9, wherein said napDNAbp domain comprises a dead Cas9 domain, a Cas9 nickase (nCas9) domain, or a nuclease active Cas9 domain.

11. The base editor of claim 10, wherein said napDNAbp domain comprises a nCas9 domain.

12. The base editor of claim 9, wherein said napDNAbp domain is capable of binding a nucleotide sequence that does not contain a canonical PAM sequence.

13. The base editor of claim 9 further comprising a second adenosine deaminase domain.

14. The base editor of claim 13, wherein the second adenosine deaminase domain comprises a second adenosine deaminase that is a TadA adenosine deaminase.

15. The base editor of claim 14, wherein the second adenosine deaminase comprises an amino acid sequence that is at least 90% identical to the amino acid sequence of SEQ ID NO: 1.

16. A method for editing a nucleobase of a DNA sequence, the method comprising:
   contacting said DNA sequence with the adenosine deaminase of claim 1; whereby a first nucleobase of said DNA sequence is converted to a second nucleobase.

17. The method of claim 16, wherein said first nucleobase is adenine.

18. The method of claim 16, wherein said second nucleobase is inosine.

19. The method of claim 16, whereby a third nucleobase complementary to said first nucleobase is replaced by a fourth nucleobase complementary to said second nucleobase.

20. The method of claim 19 whereby a second nucleobase is replaced with a fifth nucleobase that is complementary to said fourth nucleobase.

21. The method of claim 20, wherein said fifth nucleobase is guanine.

* * * * *